United States Patent 12,508,308 (INFLUENZA mRNA VACCINES) - sequence listing, part 8

SEQ ID NO: 35793 - RNA, 1701 nt, Artificial Sequence
  hemagglutinin__InfluenzaA__ADK33911
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaaggcaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaauuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35794 - RNA, 1701 nt, Artificial Sequence
  hemagglutinin__InfluenzaA__ADK33931
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacuguuagucucccugggggcaaucaguuucuggaugugcucuaaugggucucuacaguguagaauauguauuuaa

SEQ ID NO: 35795 - RNA, 1701 nt, Artificial Sequence
  hemagglutinin__InfluenzaA__ADK33941
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaaugcaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuauuggacacuaguagagccgggagacaaaauaacauucgaagcaacuggaaaucuagugguaccgagauaugcauucgcaauggaaagaaaugcuggaucugguauugucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuauugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35796 - RNA, 1701 nt, Artificial Sequence; identical to SEQ ID NO: 35793
  hemagglutinin__InfluenzaA__ADK33951

SEQ ID NO: 35797 - RNA, 1701 nt, Artificial Sequence; identical to SEQ ID NO: 35504
  hemagglutinin__InfluenzaA__ADK33961

SEQ ID NO: 35798 - RNA, 1701 nt, Artificial Sequence; identical to SEQ ID NO: 34117
  hemagglutinin__InfluenzaA__ADK45312

SEQ ID NO: 35799 - RNA, 1701 nt, Artificial Sequence
  hemagglutinin__InfluenzaA__ADK45410
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacaguaucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauccaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaauaccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35800 - RNA, 1701 nt, Artificial Sequence
  hemagglutinin__InfluenzaA__ADK45421
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaggauuggauccuauggauuuccuuugccauaucauguuuuuugcuuuguguugcuuuguugggguucaucaugugggccugccaaaaaggcaacauuaggugcaacauuugcauuuga

SEQ ID NO: 35801 - RNA, 1701 nt, Artificial Sequence
  hemagglutinin__InfluenzaA__ADK45432
augaagacuaucauugcuuugagcuacacucuaugucugguuuucgcucaaaaacuuccuagaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaauccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauuaaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuuuaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcugcuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcuaaagucaggguacaaagauuggauccuauggauuuccuuugccauaucauguuuuuugcuuuguguugcuuuguugggguucaucaugugggccugccaaaaaggcaacauuagaugcaacauuugcauuuga

SEQ ID NO: 35802 - RNA, 1701 nt, Artificial Sequence; identical to SEQ ID NO: 35625
  hemagglutinin__InfluenzaA__ADK45443

SEQ ID NO: 35803 - RNA, 1701 nt, Artificial Sequence
  hemagglutinin__InfluenzaA__ADK48798
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacauguuacccaggagauuucaucgauuaugaggagcuaagagagcaauugagcucagugucaucauuugaaagguuugagauguuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccauccacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauacgcauucgcaauggaaagaaaugcuggaucugguauuaucauuucagauacaccaguccacgauugcaauacaaccugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaguuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguaggauauguauuuaa

SEQ ID NO: 35804 - RNA, 1701 nt, Artificial Sequence; identical to SEQ ID NO: 35756
  hemagglutinin__InfluenzaA__ADK62683

SEQ ID NO: 35805 - RNA, 1701 nt, Artificial Sequence
  hemagglutinin__InfluenzaA__ADK62693
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagaguguggaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaaaggugcuauaaacaccagccucccauuucagaauguacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35806 - RNA, 1701 nt, Artificial Sequence
  hemagglutinin__InfluenzaA__ADK62703
augaaggcaauacuaguaguucugcuauauacauuugcaaccgcaaaugcagacacauuauguauagguuaucaugcgaacaauucaacagacacuguagacacaguacuagaaaagaaugugacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggagauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35807 - RNA, 1701 nt, Artificial Sequence
  hemagglutinin__InfluenzaA__ADK64992
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggauaaagcuggaaucaacaaggauuuaccagauuuuggcgaucuauucaacugucgccaguucauugguacugguagucucccugggggcaaucaguuucuggaugugcucuaaugggucucuacaguauagaauauguauuuaa

SEQ ID NO: 35808 - RNA, 1701 nt, Artificial Sequence
  hemagglutinin__InfluenzaA__ADK65001
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaggagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaacucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugccuggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggauguguucuaaugggucucuacaguguagaauauguauuuaa

SEQ ID NO: 35809 - RNA, 1701 nt, Artificial Sequence
  hemagglutinin__InfluenzaA__ADK65009
augaaggcaauacuaguaguucugcuauauacauuugcaaccgcaaaugcagacacauuauguauagguuaucaugcgaacaauucaacagacacuguagacacaguacuagaaaaaaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucggagcaacuggaaaccuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgaaauuacuaacaaaguaaauucuguuauugaaaagaugaauacacaguucacagcaguagguaaagaguucaaccaucuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35810 - RNA, 1701 nt, Artificial Sequence
  hemagglutinin__InfluenzaA__ADK87287
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacagucucuaccaaaagaagccaacaaacugcaaucccgaauaucggaucuagacccagaguaaggaauaucccuagcaggauaagcaucuauuggacaauaguaaaaccgggagacauacuuuugauuaacagcacagggaaucuaauugcuccuagggguuacuucaaaauacgaagugggaaaagcucaauaaugagaucagaugcacucauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaggaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcacuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35811 - RNA, 1701 nt, Artificial Sequence
  hemagglutinin__InfluenzaA__ADK87288
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuauccuuaugaugugccggauuaugccucccuuaggucacuaguugccucauccggaacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaacaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcacuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35812 - RNA, 1701 nt, Artificial Sequence
  hemagglutinin__InfluenzaA__ADK87289
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacugggguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccuaauaucggaucuagacccagaguaaggaauaucccuagcagaauaagcaucuauuggacaauaguaaaaccgggagacauacuucugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugggaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcacuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35813 - RNA, 1701 nt, Artificial Sequence
  hemagglutinin__InfluenzaA__ADK87291
augaagacuaucauugcuuugagcuacauucaaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccagauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucucccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugggaaauauguugaggacacuaaaauagaucucuggucauacaacgcggagcuucuuguugcccuggagaaucaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcacuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35814 - RNA, 1701 nt, Artificial Sequence
  hemagglutinin__InfluenzaA__ADK87293
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaagacggaacaagcucugcuugcauaaggagaucuaaaaacaguuucuuuaguaaauugaauugguugacccacuuaaacuucaaauacccagcauugaacgugacuaugccaaacaaugaacaauuugacaaauuguacauuugggggguucaccacccggguacggacaaggaccaaaccuuccuguaugcucaagcaucaggaagaaucacagucucuaccaaaagaagccaacaaacugcaaucccgaauaucggaucuagacccagaguaaggaauaucccuagcaggauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaggaauucucagaagucgaagggagaauucaggaccuugagaaauauguugaggacacuaaaauagaucucuggucauacaacgcggagcuucuuguugcccuggagaaccaacauacaauugaucuaacugacucagaaaugagcaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcacuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35815 - RNA, 1701 nt, Artificial Sequence
  hemagglutinin__InfluenzaA__ADK87295
augaagacuaucauugcuuugagcuacauucuaugucugguuuucgcucaaaaacuuccuggaaaugacaacagcacggcaacacugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugacggaaaaaacugcacacuaauagaugcucuauugggagacccucagugugauggcuuccaaaauaagaaaugggaccuuuuuguugaacgcagcaaagccuacagcaacuguuacccuuaugaugugccagauuaugccucccuuaggucacuaguugccucauccggcucacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcagagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcacuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggcgcaacauuugcauuuga

SEQ ID NO: 35816 - RNA, 1701 nt, Artificial Sequence
  hemagglutinin__InfluenzaA__ADK87296
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcugaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaggcaacuggaaaucuagugguaccgagaugugcauucgcaauggaaagaaaugcuggaucugguauuaucauuucagauacaccaguccacgauugcaauacaacuugucagacacccaagggugcuauaaacaccagccucccauuucagaauauacauccgaucacaauugggaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguaggcaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuga

SEQ ID NO: 35817 - RNA, 1701 nt, Artificial Sequence
  hemagglutinin__InfluenzaA__ADK87298
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaguggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguaauaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauccuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuga

SEQ ID NO: 35818 - RNA, 1701 nt, Artificial Sequence
  hemagglutinin__InfluenzaA__ADK87300
augaagacuaucauugcuuugagcuacauucuauguaugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacagucucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaaucgcuccgagggguuacuucaaaauacgaagugggaaaagcucaauaaugagaucagaugcacccaucggcaaaugcaauucugaaugcaucgcuccaaauggaagcauucccaaugacaaaucauuccaaaauguaaacaggaucacauacggggccugucccagauauguuaagcaaaacacucugaaauuggcaacagggaugcgaaaugugccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguauacagagaugaagcacuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35819 - RNA, 1701 nt, Artificial Sequence
  hemagglutinin__InfluenzaA__ADK87302
augaagacuaucaucgcuuugagcuacauucuauguaugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccgagggguuacuucaaaauacgaagugggaaaagcucaauaaugagaucagaugcacccaucggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaaugugccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguauacagagaugaagcacuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcgacauuugcauuuga

SEQ ID NO: 35820 - RNA, 1701 nt, Artificial Sequence
  hemagglutinin__InfluenzaA__ADK87304
augaagacuaucauugcuuugagcuacauucuaugucugguuuucgcucaaaaaauuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucuggaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauggccacgauguauacagagaugaagcacuaaacaaccgguuucagaucaagggaguugagcugaagucaggguacaaagauugguuccuauggauuuccuuugccauaucauguuuuuugcuuuguguugcuuuguugggguucaucaugugggccugccaaaaaggcaacauuaggugcaacauuugcauuuga

SEQ ID NO: 35821 - RNA, 1701 nt, Artificial Sequence
  hemagglutinin__InfluenzaA__ADK87306
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcugcugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguuggacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcaggauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggggugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaauggaucaaaucaaugggaagcugaauagauugaucgggaaaaccaacgagaaacuccaucagacugaaaaggaauucucagaagucgaagggagaauucaggaccuugagaaauauguugaggacacuaaaauagaucucuggucauacaacgcggagcuucuuguugcccuggagagccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcacuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35822 - RNA, 1701 nt, Artificial Sequence
  hemagglutinin__InfluenzaA__ADK87308
augaagacuaucauugcuuugagcuacauucuauguaugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccgagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguauacagagaugaagcacuaaacaaccgguuucagaucaagggaguugagcugaagucaggguacaaagauuggauccuauggauuuccuuugccauaucauguuuuuugcuucguguugcuuuguugggguucaucaugugggccugccaaaaaggcaacauuaggugcaacauuugcauuuga

SEQ ID NO: 35823 - RNA, 1701 nt, Artificial Sequence
  hemagglutinin__InfluenzaA__ADK87309
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucgaucagaaauggaacuuaugaccacgauguauacagagaugaagcacuaaacaaccgguuucagaucaagggaguugagcugaagucaggguacaaagauuggauccuauggauuuccuuugccauaucauguuuuuugcuuuguguugcuuugucgggguucaucaugugggccugccaaaaaggcaacauuaggugcaacauuugcauuuga

SEQ ID NO: 35824 - RNA, 1701 nt, Artificial Sequence
  hemagglutinin__InfluenzaA__ADK87310
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacauccaguucagacaauggaacguguuacccaggagauuucaucgauuaugaggagcuaagagagcaauugagcucagugucaucauuugaaagguuugagauauuccccaagacagguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuga

SEQ ID NO: 35825 - RNA, 1701 nt, Artificial Sequence
  hemagglutinin__InfluenzaA__ADK87311
augaaggcaauacuaguaguucuacuauauacauuugcaaccgcaaaugcagacacauuauguauagguuaucaugcggacaauucaacagacacuguagacacaguacuagaaaggaaugugacaguaacacacucuguuaaccuucuagaagacaagcauaacgggaaauuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcuggccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccccccauuucagaauauacauccgaucacaauuggaaaauguccaaaauauguaaaaagcacaaaauugagacuggcuacaggauugaggaaugucccuucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagaucacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuga

SEQ ID NO: 35826 - RNA, 1701 nt, Artificial Sequence
  hemagglutinin__InfluenzaA__ADK87313
augaagacuaucauugcuuugagcuacauucuaugucugguuuucgcucagaaaauuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucgcagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucuggaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauuccgagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcacuaaacaaccgguuucagaucaagggaguugagcugaagucaggguacaaagauugguuccuauggauuuccuuugccauaucauguuuuuugcuuuguguugcuuuguugggguucaucaugugggccugccaaaaaggcaacauuaggugcaacauuugcauuuga

SEQ ID NO: 35827 - RNA, 1701 nt, Artificial Sequence
  hemagglutinin__InfluenzaA__ADK87315
augaaggcaauacuaguaguucugcuauauacauuugcaaccgcaaaugcagacacauuauguauagguuaucaugcgaacaacucaacagacacuguagacacaguacuagaaaagaauguaacaguaacacacucuguuaaccuucuagaagacaagcauaacgggaagcuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguccauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaguguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaacgagcaggggucaggauaugcagccgaccugaagagcacacagaaugccauugacgagauuacuaacaaaguaaauucuguuauugaaaagaugaauacacaguucacagcaguagguaaagaguccaaccaccuggaaacaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauagcacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuga

SEQ ID NO: 35828 - RNA, 1701 nt, Artificial Sequence
  hemagglutinin__InfluenzaA__ADK87317
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaagcuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagggagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuga

SEQ ID NO: 35829 - RNA, 1701 nt, Artificial Sequence
  hemagglutinin__InfluenzaA__ADK87319
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaagcuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacagaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccggauuuuggcgaucuauucaacugucgccaguucauugguacugguagucucccugggggcaaucaguuucuggaugugcucuaaugggucucuacaguguagaauauguauuuga

SEQ ID NO: 35830 - RNA, 1701 nt, Artificial Sequence
  hemagglutinin__InfluenzaA__ADK87321
augaagacuaucauugcuuugagcuacauucuaugucugguuuucgcucaaaaaauuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcaugaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcgucuauuggacaauaguaaaaccgggagacauacuuuugauuaacagcacagggaaucuaauugcuccuagggguuacuucaaaauacgaagugggaaaagcucaauaaugagaucagaugcauccauuggcaaaugcaauucuggaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucccagaagucgaagggagaauucaggaccuugagaaauauguugaggacacuaaaauagaucucuggucauacaacgcggagccucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcacuaaacaaccgguuucagaucaagggaguugagcugaagucaggguacaaagauugguuccuauggauuuccuuugccauaucauguuuuuugcuuuguguugcuuuguugggguucaucaugugggccugccaaaaaggcaacauuaggugcaacauuugcauuuga

SEQ ID NO: 35831 - RNA, 1701 nt, Artificial Sequence
  hemagglutinin__InfluenzaA__ADK87323
augaagacuaucauugcuuugagcuacauucuaugucugguuuucgcucaaaaacuuccuggaaaugacaacagcacggcaacgcugugccucgggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccagauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguagggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucggaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucagacaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcacuaaacaaccgguuucagaucaagggaguugagcugaaaucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35832 - RNA, 1701 nt, Artificial Sequence
  hemagglutinin__InfluenzaA__ADK87325
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccagauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagacauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcacuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35833 - RNA, 1701 nt, Artificial Sequence
  hemagglutinin__InfluenzaA__ADK87326
augaagacuaucauugcuuugagcuacauucuaugccugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcaggauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcgggguucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaggaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcacuaaacaaccgguuucagaucaagggaguugagcugaagucagggugcaaagauuggauccuauggauuuccuuugccauaucauguuuuuugcuuuguguugcuuuguugggguucaccaugugggccugccaaaaaggcaacauuaggugcaacauuugcauuuga

SEQ ID NO: 35834 - RNA, 1701 nt, Artificial Sequence
  hemagglutinin__InfluenzaA__ADK87328
augaaggcaauacuaguaguucugcuauauacauuugcaaccgcaaaugcagacacauuauguauagguuaucaugcgaacaauucaacagacacuguagacacaguacuagaaaagaauguaacaguaacacacuccguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagagugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaagaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuga

SEQ ID NO: 35835 - RNA, 1701 nt, Artificial Sequence
  hemagglutinin__InfluenzaA__ADK87334
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacuagugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguaaauugaauugguugacccacuuaaacuucaaauacccagcauugaacgugacuaugccaaacaaugaacaauuugacaaauuguacauuugggggguucgccacccggguacggacaaagaccaaaucuuccuguaugcucaagcaucaggaagaaucacagucucuaccaaaagaagccaacaaacuguaaucccgaauaucggaucuagacccagaguaaggaauaucccuagcagaauaagcaccuauuggacaauaguaaaaccgggagacauacuuuuaauuaacagcacagggaaucuaauugcuccuagggguuacuucaaaauacgaagugggaaaagcucaauaaugagaucagauacacccauuggcaaaugcaauucugaaugcaucacuccgaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauacguugaggacacuaaaauagaucucuggucauacaacgcggagcuucuuguugcccuggagaaccaacauacaauugaucuaacugacucagaaaugaacaaacuguuugaaaaaacaaaaaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggaucuuauggauuuccuuugccauaucauguuuuuugcuuuguguugcuuuguugggguucaucaugugggccugccaaaaaggcaacauuaggugcaacauuugcauuuga

SEQ ID NO: 35836 - RNA, 1701 nt, Artificial Sequence
  hemagglutinin__InfluenzaA__ADK87336
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacuaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuacgccucccuuaggucacuaguugccucauccggcacacuggaguuuaacaaugaaagcuucaauuggacuggagucacucaaaacggaacaagcucugcuugcauaaggagaucuaaaaacaguuucuuuaguaaauugaauugguugacccacuuaaacuucaaauacccagcauugaacgugacuaugccaaacaaugaacaauuugacaaauuguacauuugggggguucaccacccggguacggacagagaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuuaauuaacagcacagggaaucuaauugcuccuagggguuacuucaaaauacgaagugggaaaagcucaauaaugagaucagauacacccauuggcaaaagcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauacguugaggacacuaaaauagaucucuggucauacaacgcggagcuucuuguugcccuggagaaccaacauacaauugaucuaacugacucagaaaugaacaaacuguuugaaaaaacaaaaaagcaacugagggaagaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggaucuuauggauuuccuuugccauaucauguuuuuugcuuuguguugcuuuguugggguucaucaugugggccugccaaaaaggcaacauuaggugcaacauuugcauuuga

SEQ ID NO: 35837 - RNA, 1701 nt, Artificial Sequence
  hemagglutinin__InfluenzaA__ADK87338
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagagguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaaucuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuacucaacugucgccaguucauugguacugguagucucccugggggcaaucaguuucuggauguguucuaaugggucucuacaguguagaauauguauuuga

SEQ ID NO: 35838 - RNA, 1701 nt, Artificial Sequence
  hemagglutinin__InfluenzaA__ADK90193
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaaguaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35839 - RNA, 1701 nt, Artificial Sequence
  hemagglutinin__InfluenzaA__ADK90194
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaauugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35840 - RNA, 1701 nt, Artificial Sequence
  hemagglutinin__InfluenzaA__ADK90195
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauugucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaauugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35841 - RNA, 1701 nt, Artificial Sequence
  hemagglutinin__InfluenzaA__ADK90196
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcgguaggcaaggaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35842 - RNA, 1701 nt, Artificial Sequence
  hemagglutinin__InfluenzaA__ADK90197
augagggcaauacuaggaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35843 - RNA, 1701 nt, Artificial Sequence
  hemagglutinin__InfluenzaA__ADK90198
augaaggcaauacuaggaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35844 - RNA, 1701 nt, Artificial Sequence; identical to SEQ ID NO: 33173
  hemagglutinin__InfluenzaA__ADK90199

SEQ ID NO: 35845 - RNA, 1701 nt, Artificial Sequence
  hemagglutinin__InfluenzaA__ADK90200
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcguauguuuuuguggggacaucaagauacagcaagaaguucaagccggaaauagcaauaagacccaaagugagggaucaagaggggagaaugaacuauuacuggacacuaguagagccgggagacaaaauagcauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcggucuauucaacugucgccaguucauugguacugguagucucccugggggcaaucaguuucuggaugugcucuaaugggucucuacaguguagaauauguauuuaa

SEQ ID NO: 35846 - RNA, 1701 nt, Artificial Sequence
  hemagglutinin__InfluenzaA__ADK90201
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaguaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35847 - RNA, 1701 nt, Artificial Sequence
  hemagglutinin__InfluenzaA__ADK90202
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaccacucuccacagcaagcucaugguccuacauuguggaaacaucuaguucagacaauggaacguguuacccaggagauuucaucgauuaugaggagcuaagagagcaauugagcucagugucaucauuugaaaggcuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaacggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacgcagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35848 - RNA, 1701 nt, Artificial Sequence; identical to SEQ ID NO: 33390
  hemagglutinin__InfluenzaA__ADK90203

SEQ ID NO: 35849 - RNA, 1701 nt, Artificial Sequence
  hemagglutinin__InfluenzaA__ADK90204
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucuuuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugaacaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35850 - RNA, 1701 nt, Artificial Sequence
  hemagglutinin__InfluenzaA__ADK94191
augaagacuaucauugcuuugagcuacauucuaugucugguuuucgcucaaaaacuuccuggaaaugacaacagcacggcaacgcugugccuugggcaccaugcaguaccaaacggaacgguagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacuguaaucccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35851 - RNA, 1701 nt, Artificial Sequence
  hemagglutinin__InfluenzaA__ADK94202
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagucaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaaugugaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucugacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35852 - RNA, 1701 nt, Artificial Sequence
  hemagglutinin__InfluenzaA__ADK94213
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauuaaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuauuuuaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35853 - RNA, 1701 nt, Artificial Sequence
  hemagglutinin__InfluenzaA__ADK94224
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuucuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35854 - RNA, 1701 nt, Artificial Sequence
  hemagglutinin__InfluenzaA__ADK94257
auggagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggggucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagagggcaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35855 - RNA, 1701 nt, Artificial Sequence
  hemagglutinin__InfluenzaA__ADK94268
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucaaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaggauuggauccuauggauuuccuuugccauaucauguuuuuugcuuuguguugcuuuguugggguucaucaugugggccugccaaaaaggcaacauuaggugcaacauuugcauuuga

SEQ ID NO: 35856 - RNA, 1701 nt, Artificial Sequence
  hemagglutinin__InfluenzaA__ADK94279
augaagacuaucauugcuuugagcuacauucuaugucugguuuucgcucaaaaacuuccuggaaaugacaacagcacggcaacgcuaugccuugggcaccaugcaguaccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcauaaggagaucuaauaacaguuucuuuaguagauugaauugguugacccacuuaaaauucaaauacccagcauuaaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35857 - RNA, 1701 nt, Artificial Sequence
  hemagglutinin__InfluenzaA__ADK94290
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccgggcacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35858 - RNA, 1701 nt, Artificial Sequence
  hemagglutinin__InfluenzaA__ADK94301
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35859 - RNA, 1701 nt, Artificial Sequence
  hemagglutinin__InfluenzaA__ADK94323
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcuaaauagauugaucgggaaaaccaaugagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuaa

SEQ ID NO: 35860 - RNA, 1701 nt, Artificial Sequence; identical to SEQ ID NO: 35850
  hemagglutinin__InfluenzaA__ADK94441

SEQ ID NO: 35861 - RNA, 1701 nt, Artificial Sequence
  hemagglutinin__InfluenzaA__ADK94476
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuuggggggcucaccacccggguacggacaaagaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35862 - RNA, 1701 nt, Artificial Sequence; identical to SEQ ID NO: 35853
  hemagglutinin__InfluenzaA__ADK94487

SEQ ID NO: 35863 - RNA, 1701 nt, Artificial Sequence
  hemagglutinin__InfluenzaA__ADK94498
augaagacuaucauugcuuugagcuacauucuaugucugguuuucgcucaaaaacuuccuggaaaugacaacagcacggcaacgcugugccuugggcaccaugcaguaccaaacggaacgguagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggggacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35864 - RNA, 1701 nt, Artificial Sequence
  hemagglutinin__InfluenzaA__ADK94509
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagguugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauauuaagcaaaacacucugaaauuggcaacagggaugcgaaauguaccagagaaacaaacuagaggcauauuuggcgcaaucgcggguuucauagaaaaugguugggaggggaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggaaaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35865 - RNA, 1701 nt, Artificial Sequence
  hemagglutinin__InfluenzaA__ADK94520
augaagacuaucauugcuuugagcuacauucuaugucugguuuucgcucaaaaacuuccuggaaaugacaacagcacggcaacgcugugccuugggcaccaugcaguaccaaacggaacgauagugaaaacaauaacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcauaaggagaucuaauaacaguuucuuuaguagauuaaauugguugacccacuuaagauucaaguacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacaccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucggaaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucaggaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaagugcaacauuugcauuuga

SEQ ID NO: 35866 - RNA, 1701 nt, Artificial Sequence
  hemagglutinin__InfluenzaA__ADK94531
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauauuggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaaugugccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35867 - RNA, 1701 nt, Artificial Sequence
  hemagglutinin__InfluenzaA__ADK94542
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggaccggagucacucaaaacgggacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuucuuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaacucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgguaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35868 - RNA, 1701 nt, Artificial Sequence
  hemagglutinin__InfluenzaA__ADK94553
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucaaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaauguaacaaugcaugcauaggaucaaucagaaauggaacuuaugaccacgauguauacagagaugaagcauuaaacaaccgguuucagaucaagggaguugagcugaagucaggguacaaggauuggauccuauggauuuccuuugccauaucaugcuuuuugcuuuguguugcuuuguugggguucaucaugugggccugccaaaaaggcaacauuaggugcaacauuugcauuuga

SEQ ID NO: 35869 - RNA, 1701 nt, Artificial Sequence; identical to SEQ ID NO: 35866
  hemagglutinin__InfluenzaA__ADK94564

SEQ ID NO: 35870 - RNA, 1701 nt, Artificial Sequence
  hemagglutinin__InfluenzaA__ADK98501
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucaggcaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaagggaacucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaaacaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgagcuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35871 - RNA, 1701 nt, Artificial Sequence
  hemagglutinin__InfluenzaA__ADK98503
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaauguagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35872 - RNA, 1701 nt, Artificial Sequence
  hemagglutinin__InfluenzaA__ADK98623
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaggauuggauccuauggauuuccuuugccauaucauguuuuuugcuuuguguugcuuuguugggguucaucaugugggccugccaaaaaggcaacauuaggugcaacauuugcauuuga

SEQ ID NO: 35873 - RNA, 1701 nt, Artificial Sequence
  hemagglutinin__InfluenzaA__ADK98634
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauuaaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuuuaaaauacgaagugggaaaagcucaauaaugagaucagaugcacccauuggcaaaugcaauucugaaugcaucaccccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagagaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuucgccauaucauguuuuuugcuuuguguugcuuuguugggguucaucaugugggccugccaaaaaggcaacauuaggugcaacauuugcauuuga

SEQ ID NO: 35874 - RNA, 1701 nt, Artificial Sequence
  hemagglutinin__InfluenzaA__ADK98645
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacaguaucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucuaaaauuggcaacaggaaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauccaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauugaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35875 - RNA, 1701 nt, Artificial Sequence; identical to SEQ ID NO: 35801
  hemagglutinin__InfluenzaA__ADK98656

SEQ ID NO: 35876 - RNA, 1701 nt, Artificial Sequence; identical to SEQ ID NO: 35868
  hemagglutinin__InfluenzaA__ADK98667

SEQ ID NO: 35877 - RNA, 1701 nt, Artificial Sequence
  hemagglutinin__InfluenzaA__ADK98678
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacucaaaauggaagcauucccaaugauaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacggauucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35878 - RNA, 1701 nt, Artificial Sequence; identical to SEQ ID NO: 35874
  hemagglutinin__InfluenzaA__ADK98689

SEQ ID NO: 35879 - RNA, 1701 nt, Artificial Sequence
  hemagglutinin__InfluenzaA__ADK98700
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugauaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacggauucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35880 - RNA, 1701 nt, Artificial Sequence
  hemagglutinin__InfluenzaA__ADK98711
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauuaaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuuuaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcgggcuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagagaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35881 - RNA, 1701 nt, Artificial Sequence
  hemagglutinin__InfluenzaA__ADK98722
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacaguaucuaccaaaggaagccaacaaacuguaauuccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucuaaaauuggcaacaggaaugcgaaauguaccagagaaacaaacuagaggcauauuuggcgcgaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauccaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauugaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35882 - RNA, 1701 nt, Artificial Sequence; identical to SEQ ID NO: 35872
  hemagglutinin__InfluenzaA__ADK98733

SEQ ID NO: 35883 - RNA, 1701 nt, Artificial Sequence; identical to SEQ ID NO: 35874
  hemagglutinin__InfluenzaA__ADK98744

SEQ ID NO: 35884 - RNA, 1701 nt, Artificial Sequence
  hemagglutinin__InfluenzaA__ADK98777
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguuaacccacuuaaaauucaaauacccagcauuaaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35885 - RNA, 1701 nt, Artificial Sequence
  hemagglutinin__InfluenzaA__ADK98788
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaacuguacauuugggggguucaccacccggguacggacaaugaccaaaucuuccuguaugcucaagcaucaggaagaaucacaguaucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauccaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauugaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35886 - RNA, 1701 nt, Artificial Sequence; identical to SEQ ID NO: 34117
  hemagglutinin__InfluenzaA__ADK98799

SEQ ID NO: 35887 - RNA, 1701 nt, Artificial Sequence
  hemagglutinin__InfluenzaA__ADK98810
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagacugaauugguugacccacuuaaaauucaaauacccagcauuaaacgugacuaugccaaacaaugaacaauuugacaaauuguacauuugggggguucaccacccggguacggacaaugaccaaaccuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguauacagagaugaagcauuaaacaaccgguuccagaucaaggaaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35888 - RNA, 1701 nt, Artificial Sequence
  hemagglutinin__InfluenzaA__ADK98821
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaggaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35889 - RNA, 1701 nt, Artificial Sequence
  hemagglutinin__InfluenzaA__ADK98832
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacaguaucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauccaggaccuugagaaauauguugaggacacuaaaauagaucucuggucauacaacgcggagcuucuuguugcccuggagaaccaacauacaauugaucuaacugacucagaaaugaacaaacuguuugaaaagacaaagaagcaacugagggaaaaugcugaggauaugggcaaugguuguuucaaaauauaccacaaaugugacaaugccugcauaggaucaaucagaaauggaacuuaugaccacgauguauacagagaugaagcauugaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35890 - RNA, 1701 nt, Artificial Sequence; identical to SEQ ID NO: 35868
  hemagglutinin__InfluenzaA__ADK98843

SEQ ID NO: 35891 - RNA, 1701 nt, Artificial Sequence
  hemagglutinin__InfluenzaA__ADK98854
augaagacuaucauugcuuugagcuacauucuaugucugguuuucacucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacaguaucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucuaaaauuggcaacaggaaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauccaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauugaacaaccgguuccagaucaagggaguugagcugaagccaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35892 - RNA, 1701 nt, Artificial Sequence
  hemagglutinin__InfluenzaA__ADK98865
augaagacuaucauugcuuugagcuacauucuaugucugguuuucgcucaaaaacuuccuggaagugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugaugacuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucagaacggaacaagcucugcuugcauaaggagaucuaguaacaguuucuuuaguagauugaacugguugacccacuuaagauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagaccaagaguaaggaauaucccuagcagaauaagcaucuauuggacaauaguaaaaccgggagacauacuuuugauuaacagcacagggaaucuaauugcuccuagagguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaacucugagggaagaggacaagcagcagaucucaaaagcacucaagcagcaaucgaucaaaucaaugggaagcugaacagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguagcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35893 - RNA, 1701 nt, Artificial Sequence
  hemagglutinin__InfluenzaA__ADK98876
augaagacuaucauugcuuugagcuacauucuaugucugguuuucgcucaaaaacuuccuggaaaugacaacagcacggcaacgcugugccuugggcaccaugcaguaccgaacggaacgauagugaaaacaaucacgaaugaccaaauugaaguuacuaaugcuacugagcugguucagaauuccucaacaggugaaauaugcgacaguccccaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaauggacaauuugacaaauuguacauuugggggguucaccacccggguacggacaaagaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggaaggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35894 - RNA, 1701 nt, Artificial Sequence; identical to SEQ ID NO: 35868
  hemagglutinin__InfluenzaA__ADK98887

SEQ ID NO: 35895 - RNA, 1701 nt, Artificial Sequence; identical to SEQ ID NO: 35874
  hemagglutinin__InfluenzaA__ADK98898

SEQ ID NO: 35896 - RNA, 1701 nt, Artificial Sequence
  hemagglutinin__InfluenzaA__ADK98909
augaagacuaucauugcuuugagcuacauucuaugucugguuuucgcucaaaaacuuccuggaaaugacaacagcacggcaacgcugugccuugggcaucaugcaguaccaaacggaacgauagugaaaacaaucacgaaugaccaaauugaaguuacuaaugcuacugagcugguucagauuuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauuaaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaaacugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccuguauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35897 - RNA, 1701 nt, Artificial Sequence
  hemagglutinin__InfluenzaA__ADK98920
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcggcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaggauuggauccuauggauuuccuuugccauaucauguuuuuugcuuuguguugcuuuguugggguucaucaugugggccugccaaaaaggcaacauuaggugcaacauuugcauuuga

SEQ ID NO: 35898 - RNA, 1701 nt, Artificial Sequence
  hemagglutinin__InfluenzaA__ADK98931
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuguuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauuaaacgugacuaugccaaacaaugaacaauuugacaaauuguacauuugggggguucaccacccggguacggacaaugaccaaaucuuccuguaugcucaagcaucaggaagaaucacaguuucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagacgaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35899 - RNA, 1701 nt, Artificial Sequence
  hemagglutinin__InfluenzaA__ADK98942
augaagacuaucauugcuuugagcuacauccuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauuaaacgugacuaugccaaacaaugaacaauuugacaaauuguauauuugggggguucaccacccggguacggacaaugaccaaaucuuccuguaugcucaagcaucaggaagaaucacagucucuaccaaaagaagccaacaaacuguaaucucgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35900 - RNA, 1701 nt, Artificial Sequence
  hemagglutinin__InfluenzaA__ADK98953
augaagacuaucauugcuuugagcuacaugcuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacggagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauuaaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucagacaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35901 - RNA, 1701 nt, Artificial Sequence
  hemagglutinin__InfluenzaA__ADK98964
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacaguaucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauccaggaccuugagaaauauguugaggacacuaaaauagaucucuggucauacaacgcggagcuucuuguugcccuggagaaccaacauacaauugaucuaacugacucagagaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauugaacaaccgguuccagaucaaaggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35902 - RNA, 1701 nt, Artificial Sequence; identical to SEQ ID NO: 35855
  hemagglutinin__InfluenzaA__ADK98975

SEQ ID NO: 35903 - RNA, 1701 nt, Artificial Sequence; identical to SEQ ID NO: 35900
  hemagglutinin__InfluenzaA__ADK98986

SEQ ID NO: 35904 - RNA, 1701 nt, Artificial Sequence; identical to SEQ ID NO: 34117
  hemagglutinin__InfluenzaA__ADK98997

SEQ ID NO: 35905 - RNA, 1701 nt, Artificial Sequence; identical to SEQ ID NO: 35900
  hemagglutinin__InfluenzaA__ADK99008

SEQ ID NO: 35906 - RNA, 1701 nt, Artificial Sequence
  hemagglutinin__InfluenzaA__ADK99030
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacgauuugacaaauuguacauuugggggguucaccacccggguacggacaaagaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35907 - RNA, 1701 nt, Artificial Sequence
  hemagglutinin__InfluenzaA__ADK99041
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucgcgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauuaaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauccccaaugacaaaccauuccaaaauguaaacaggaucacauacggggccugucccagauauguuaagcaaaacacucugaaauuggcaacagggaugcgaaauguaccagagaaacaaacuagaggcauauuuggugcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaggggagaauucaggaccuugagaaauauguugaagacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35908 - RNA, 1701 nt, Artificial Sequence; identical to SEQ ID NO: 35872
  hemagglutinin__InfluenzaA__ADK99063

SEQ ID NO: 35909 - RNA, 1701 nt, Artificial Sequence; identical to SEQ ID NO: 35884
  hemagglutinin__InfluenzaA__ADK99085

SEQ ID NO: 35910 - RNA, 1701 nt, Artificial Sequence; identical to SEQ ID NO: 35874
  hemagglutinin__InfluenzaA__ADK99096

SEQ ID NO: 35911 - RNA, 1701 nt, Artificial Sequence; identical to SEQ ID NO: 35874
  hemagglutinin__InfluenzaA__ADK99107

SEQ ID NO: 35912 - RNA, 1701 nt, Artificial Sequence
  hemagglutinin__InfluenzaA__ADK99118
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacauuccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucaaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaauguaacaaugcaugcauaggaucaaucagaaauggaacuuaugaccacgauguauacagagaugaagcauuaaacaaccgguuucagaucaagggaguugagcugaagucaggguacaaggauuggauccuauggauuuccuuugccauaucaugcuuuuugcuuuguguugcuuuguugggguucaucaugugggccugccaaaaaggcaacauuaggugcaacauuugcauuuga

SEQ ID NO: 35913 - RNA, 1701 nt, Artificial Sequence
  hemagglutinin__InfluenzaA__ADK99129
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucaaaaaacaguuucuuuaguagauugaauugguugacccacuuaaacuucaaauacccagcauugaacaugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaauguaacaaugcaugcauaggaucaaucagaaauggaacuuaugaccacgauguauacagagaugaagcauuaaacaaccgguuucagaucaagggaguugagcugaagucaggguacaaggauuggauccuauggauuuccuuugccauaucaugcuuuuugcuuuguguugcuuuguugggguucaucaugugggccugccaaaaaggcaacauuaggugcaacauuugcauuuga

SEQ ID NO: 35914 - RNA, 1701 nt, Artificial Sequence; identical to SEQ ID NO: 35855
  hemagglutinin__InfluenzaA__ADK99140

SEQ ID NO: 35915 - RNA, 1701 nt, Artificial Sequence
  hemagglutinin__InfluenzaA__ADK99151
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuacaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucuaaaugcaucaccccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35916 - RNA, 1701 nt, Artificial Sequence
  hemagglutinin__InfluenzaA__ADK99162
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucaaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaaguacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaggauuggauccuauggauuuccuuugccauaucauguuuuuugcuuuguguugcuuuguugggguucaucaugugggccugccaaaaaggcaacauuaggugcaacauuugcauuuga

SEQ ID NO: 35917 - RNA, 1701 nt, Artificial Sequence
  hemagglutinin__InfluenzaA__ADK99173
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugauucagaguuccucaacaggugaaauaugcgacaguccucaucagauccuugauggagaaaacugcacacuaauagaugcucuauugggagacccucagugugauggccuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacaguaucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucuaaaauuggcaacaggaaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauccaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauugaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35918 - RNA, 1701 nt, Artificial Sequence
  hemagglutinin__InfluenzaA__ADK99184
augaagacuaucauugcuuugagcuacauucuaugucugguuuccgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauuaaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugcgacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35919 - RNA, 1701 nt, Artificial Sequence; identical to SEQ ID NO: 35885
  hemagglutinin__InfluenzaA__ADK99195

SEQ ID NO: 35920 - RNA, 1701 nt, Artificial Sequence
  hemagglutinin__InfluenzaA__ADK99206
augaagacuaucauugcuuugagcuacauucuaugucugguuuucgcucaaaaacuuccuggaaaugacaacagcacggcaacgcugugccuugggcaccaugcaguaccaaacggaacgguagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggaggucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacuguaaucccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguuucccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35921 - RNA, 1701 nt, Artificial Sequence; identical to SEQ ID NO: 35855
  hemagglutinin__InfluenzaA__ADK99217

SEQ ID NO: 35922 - RNA, 1701 nt, Artificial Sequence; identical to SEQ ID NO: 35872
  hemagglutinin__InfluenzaA__ADK99228

SEQ ID NO: 35923 - RNA, 1701 nt, Artificial Sequence
  hemagglutinin__InfluenzaA__ADK99239
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugagagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35924 - RNA, 1701 nt, Artificial Sequence
  hemagglutinin__InfluenzaA__ADK99250
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuguuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauuaaacgugacuaugccaaacaaugaacaauuugacaaauuguacauuugggggguucaccacccggguacggacaaugaccaaaucuuccuguaugcucaagcaucaggaagaaucacaguuucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgaaaaauuccaucagauugaaaaagaauucucagaagucgaagggagaauucaggacauugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagacgaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35925 - RNA, 1701 nt, Artificial Sequence; identical to SEQ ID NO: 35855
  hemagglutinin__InfluenzaA__ADK99261

SEQ ID NO: 35926 - RNA, 1701 nt, Artificial Sequence
  hemagglutinin__InfluenzaA__ADK99283
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugugaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacggcuucaggcaucaaaauucugagggaagaggacaagcagcagaucucaaaagcacucaagcagcaaucgaucaaaucaaugggaagcugaauagauugauugggaaaaccaacgagaaauuccaucagauugaaaaagaauucucagaagucgaagggagaauucaggaccuugagagauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35927 - RNA, 1701 nt, Artificial Sequence
  hemagglutinin__InfluenzaA__ADK99294
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaagauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35928 - RNA, 1701 nt, Artificial Sequence; identical to SEQ ID NO: 35874
  hemagglutinin__InfluenzaA__ADK99305

SEQ ID NO: 35929 - RNA, 1701 nt, Artificial Sequence; identical to SEQ ID NO: 35885
  hemagglutinin__InfluenzaA__ADL27989

SEQ ID NO: 35930 - RNA, 1701 nt, Artificial Sequence
  hemagglutinin__InfluenzaA__ADL28000
augaagacuaucauugcuuugagcuacauucuaugucugguuuucgcucaaaaacuuccuggaaaugacaacagcacggcaacgcugugccuugggcaccaugcaguaccaaacggaacgauggugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucagaaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaggauuggauccuauggauuuccuuugccauaucauguuuuuugcuuuguguugcuuuguugggguucaucaugugggccugccaaaaaggcaacauuaggugcaacauuugcauuuga

SEQ ID NO: 35931 - RNA, 1701 nt, Artificial Sequence
  hemagglutinin__InfluenzaA__ADL28011
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauuaaacgugacuaugccaaacaaugaacaauuugacaaauuguacauuugggggguucaccacccggguacggacaaugaccaaaucuuccuguaugcucaagcaucaggaagaaucacagucucuaccagaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35932 - RNA, 1701 nt, Artificial Sequence; identical to SEQ ID NO: 35916
  hemagglutinin__InfluenzaA__ADL28022

SEQ ID NO: 35933 - RNA, 1701 nt, Artificial Sequence; identical to SEQ ID NO: 35874
  hemagglutinin__InfluenzaA__ADL28033

SEQ ID NO: 35934 - RNA, 1701 nt, Artificial Sequence; identical to SEQ ID NO: 34117
  hemagglutinin__InfluenzaA__ADL28044

SEQ ID NO: 35935 - RNA, 1701 nt, Artificial Sequence
  hemagglutinin__InfluenzaA__ADL28055
augaagacuaucguugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauuaaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggacaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35936 - RNA, 1701 nt, Artificial Sequence; identical to SEQ ID NO: 35874
  hemagglutinin__InfluenzaA__ADL28066

SEQ ID NO: 35937 - RNA, 1701 nt, Artificial Sequence; identical to SEQ ID NO: 35855
  hemagglutinin__InfluenzaA__ADL28077

SEQ ID NO: 35938 - RNA, 1701 nt, Artificial Sequence
  hemagglutinin__InfluenzaA__ADL28088
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguauucucaagcaucaggaagaaucacaguaucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauaugucaagcaaaacacucuaaaauuggcaacaggaaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauccaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauugaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35939 - RNA, 1701 nt, Artificial Sequence
  hemagglutinin__InfluenzaA__ADL28099
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugaacugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugagcaauuugacaaauuguacauuugggggguucaccacccggguacugacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcagguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaaaaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35940 - RNA, 1701 nt, Artificial Sequence
  hemagglutinin__InfluenzaA__ADL28110
augaagacuaucauugcuuugagcuacauucuaugucugguuuucgcucaaaaacuuccuggaaaugacaacagcacggcaacgcugugcauugggcaccaugcaguaccaaacggaacgauagugaaaacaaucacgaaugaccaaauugaaguuacuaaugcuacugagcugguucagaauuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauugacaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35941 - RNA, 1701 nt, Artificial Sequence
  hemagglutinin__InfluenzaA__ADL28126
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucaaucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacaguaucuaccaaaagaagccaacaaacuguaaucccgaauaucggaucuagacccagaguaagaaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucuaaaauuggcaacaggaaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauccaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauugaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35942 - RNA, 1701 nt, Artificial Sequence
  hemagglutinin__InfluenzaA__ADL28137
augaagacuaucauugcuuugagcuacauucuaugucugguuucugcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacgguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuugaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguccaccacccggguacggacaaugaccaaaucuuccuguaugcucaagcaucaggaagaaucacagucucuaccaaaagaagccaacaaacuguaaucccgaauauuggaucuagacccagaguaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguagaugguugguacggcuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucugacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35943 - RNA, 1701 nt, Artificial Sequence; identical to SEQ ID NO: 35885
  hemagglutinin__InfluenzaA__ADL28148

SEQ ID NO: 35944 - RNA, 1701 nt, Artificial Sequence; identical to SEQ ID NO: 35872
  hemagglutinin__InfluenzaA__ADL28170

SEQ ID NO: 35945 - RNA, 1701 nt, Artificial Sequence; identical to SEQ ID NO: 35874
  hemagglutinin__InfluenzaA__ADL28181

SEQ ID NO: 35946 - RNA, 1701 nt, Artificial Sequence
  hemagglutinin__InfluenzaA__ADL28192
augaagacuaucauugcuuugagcuacauucuaugucugguuuucgcucaaaaacuuccuggaaaugacaacagcacggcaacgcugugccuugggcaccaugcaguaccaaacggaacgguagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggaggucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacuguaaucccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35947 - RNA, 1701 nt, Artificial Sequence
  hemagglutinin__InfluenzaA__ADL28203
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcauaaggagaucuaauaacaguuucuuuaguagauugaauugguugacccacuuaaaauucaaauacccagcauuaaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35948 - RNA, 1701 nt, Artificial Sequence; identical to SEQ ID NO: 34103
  hemagglutinin__InfluenzaA__ADL28214

SEQ ID NO: 35949 - RNA, 1701 nt, Artificial Sequence
  hemagglutinin__InfluenzaA__ADL28225
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguauucucaagcaucaggaagaaucacaguaucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauaugucaagcaaaacacucuaaaauuggcaacaggaaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauccaggaccuugagaaauauguugaggacacuaaaacagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauugaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35950 - RNA, 1701 nt, Artificial Sequence
  hemagglutinin__InfluenzaA__ADL28236
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacuguaaucccgaauaucgggucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaggauuggauccuauggauuuccuuugccauaucauguuuuuugcuuuguguugcuuuguugggguucaucaugugggccugccaaaaaggcaacauuaggugcaacauuugcauuuga

SEQ ID NO: 35951 - RNA, 1701 nt, Artificial Sequence; identical to SEQ ID NO: 35625
  hemagglutinin__InfluenzaA__ADL28247

SEQ ID NO: 35952 - RNA, 1701 nt, Artificial Sequence; identical to SEQ ID NO: 35868
  hemagglutinin__InfluenzaA__ADL28258

SEQ ID NO: 35953 - RNA, 1701 nt, Artificial Sequence; identical to SEQ ID NO: 35901
  hemagglutinin__InfluenzaA__ADL28370

SEQ ID NO: 35954 - RNA, 1701 nt, Artificial Sequence; identical to SEQ ID NO: 33206
  hemagglutinin__InfluenzaA__ADL29672

SEQ ID NO: 35955 - RNA, 1701 nt, Artificial Sequence
  hemagglutinin__InfluenzaA__ADL29682
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuugugggaucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacagugcagaauauguauuuaa

SEQ ID NO: 35956 - RNA, 1701 nt, Artificial Sequence; identical to SEQ ID NO: 35673
  hemagglutinin__InfluenzaA__ADL29692

SEQ ID NO: 35957 - RNA, 1701 nt, Artificial Sequence
  hemagglutinin__InfluenzaA__ADL29702
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauuccguuauugaaaagaugaauacacaguucacagcaguagguaaagaguucaaccaccuggaaaaaagaauagagaauuuaaauaaaaaaauugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35958 - RNA, 1701 nt, Artificial Sequence; identical to SEQ ID NO: 35673
  hemagglutinin__InfluenzaA__ADL29730

SEQ ID NO: 35959 - RNA, 1701 nt, Artificial Sequence; identical to SEQ ID NO: 33955
  hemagglutinin__InfluenzaA__ADL29740

SEQ ID NO: 35960 - RNA, 1701 nt, Artificial Sequence
  hemagglutinin__InfluenzaA__ADL29750
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaauuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugaugagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 35961 - RNA, 1701 nt, Artificial Sequence
  hemagglutinin__InfluenzaA__ADL29760
augaaggcaauacuaguaguucugcuauauacauuugcaaccgcaaaugcagacacauuauguauagguuaucaugcaaacaauucaacagacacuguagacacaguacuagaaaagaauguaacaguaacacacucuguuaaccuucuagaauacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaaacuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35962 - RNA, 1701 nt, Artificial Sequence; identical to SEQ ID NO: 35673
  hemagglutinin__InfluenzaA__ADL29770

SEQ ID NO: 35963 - RNA, 1701 nt, Artificial Sequence
  hemagglutinin__InfluenzaA__ADL29780
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccauccacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauuccguuauugaaaagaugaauacacaguucacagcaguagguaaagaguucaaccaccuggaaaaaagaauagagaauuuaaauaaaaaaauugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35964 - RNA, 1701 nt, Artificial Sequence
  hemagglutinin__InfluenzaA__ADL29879
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauucauauguuuuuguggggacaucaaaauacagcaagaaguucaagccggaaauagcaauaagacccaaagugagggaucaagaagggagaaugaauuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 35965 - RNA, 1701 nt, Artificial Sequence
  hemagglutinin__InfluenzaA__ADL32017
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugccaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauuccguuauugaaaagaugaauacacaguucacagcaguagguaaagaguucaaccaccuggaaaaaagaauagagaauuuaaauaaaaaaauugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35966 - RNA, 1701 nt, Artificial Sequence
  hemagglutinin__InfluenzaA__ADL32037
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuaguguugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaacacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35967 - RNA, 1701 nt, Artificial Sequence; identical to SEQ ID NO: 33801
  hemagglutinin__InfluenzaA__ADL32047

SEQ ID NO: 35968 - RNA, 1701 nt, Artificial Sequence
  hemagglutinin__InfluenzaA__ADL32057
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaggucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaggcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35969 - RNA, 1701 nt, Artificial Sequence; identical to SEQ ID NO: 33801
  hemagglutinin__InfluenzaA__ADL32090

SEQ ID NO: 35970 - RNA, 1701 nt, Artificial Sequence; identical to SEQ ID NO: 33955
  hemagglutinin__InfluenzaA__ADL32114

SEQ ID NO: 35971 - RNA, 1701 nt, Artificial Sequence; identical to SEQ ID NO: 33801
  hemagglutinin__InfluenzaA__ADL32344

SEQ ID NO: 35972 - RNA, 1701 nt, Artificial Sequence; identical to SEQ ID NO: 33620
  hemagglutinin__InfluenzaA__ADL32354

SEQ ID NO: 35973 - RNA, 1701 nt, Artificial Sequence
  hemagglutinin__InfluenzaA__ADL32364
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaaugcaacauugcuggcuggauccugggaaauccagagugugaaucacucuccacagcaaucucaugguccuacauuguggaaacaucuaguucagacaauggaacguguuacccaggagauuucaucgauuaugaggagcuaagagagcaauugaguucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuauuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauuccguuauugaaaagaugaauacacaguucacagcaguagguaaagaguucaaccaccuggaaaaaagaauagagaauuuaaauaaaaaaauugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35974 - RNA, 1701 nt, Artificial Sequence
  hemagglutinin__InfluenzaA__ADL32374
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaaggcguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucaaacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugcugguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaaguguaaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35975 - RNA, 1701 nt, Artificial Sequence
  hemagglutinin__InfluenzaA__ADL32384
augaaggcaauacuaguaguucugcuauauacauuugcaaccgcaacugcagacacauuauguauagguuaucaugcaaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35976 - RNA, 1701 nt, Artificial Sequence
  hemagglutinin__InfluenzaA__ADL32394
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucauucuccacaacaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauuccguuauugaaaagaugaauacacaguucacagcaguagguaaagaguucaaccaccuggaaaaaagaauagagaauuuaaauaaaaaaauugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35977 - RNA, 1701 nt, Artificial Sequence
  hemagglutinin__InfluenzaA__ADL32404
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaaggcguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucaaacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaaguguaaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35978 - RNA, 1701 nt, Artificial Sequence
  hemagglutinin__InfluenzaA__ADL32414
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggcucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35979 - RNA, 1701 nt, Artificial Sequence
  hemagglutinin__InfluenzaA__ADL32424
augaaggcaauacuaguaguucugcuauauacauuugcaaucgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggaauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuaucacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauaaaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35980 - RNA, 1701 nt, Artificial Sequence
  hemagglutinin__InfluenzaA__ADL32434
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccauucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggauacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaaggagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35981 - RNA, 1701 nt, Artificial Sequence; identical to SEQ ID NO: 34594
  hemagglutinin__InfluenzaA__ADL32444

SEQ ID NO: 35982 - RNA, 1701 nt, Artificial Sequence
  hemagglutinin__InfluenzaA__ADL32454
auggaggcaauacuaguaguucugcuauauacauuugcaaccgcaaacgcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguggauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaacuuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35983 - RNA, 1701 nt, Artificial Sequence; identical to SEQ ID NO: 35340
  hemagglutinin__InfluenzaA__ADL32464

SEQ ID NO: 35984 - RNA, 1701 nt, Artificial Sequence; identical to SEQ ID NO: 35792
  hemagglutinin__InfluenzaA__ADL32484

SEQ ID NO: 35985 - RNA, 1701 nt, Artificial Sequence
  hemagglutinin__InfluenzaA__ADL32504
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaauguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggaauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35986 - RNA, 1701 nt, Artificial Sequence
  hemagglutinin__InfluenzaA__ADL32514
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuuuggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35987 - RNA, 1701 nt, Artificial Sequence
  hemagglutinin__InfluenzaA__ADL32524
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggauagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaaucuuacauuaaugauaaagggaaagaaguccucgugcuauggggcauucaccauccaucuacuagugccgaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuguuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35988 - RNA, 1701 nt, Artificial Sequence
  hemagglutinin__InfluenzaA__ADL32544
augaaggcaauacuaguaguucugcuauauacauuugcaaccucaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagaaaauccuacauuaaugauaaagggaaagaaguccucgugcuauggggaauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugauuacccaaaauacucagaggaagcaaaauuaaacagagaagaaauagaugggguaaagcuggaaucaacaaggauuuaucagauuuuggcgaucuauucaacugucgccaguucauugguacugguagucucccugggggcaaucaguuucuggaugugcucuaaugggucucuacaguguagaauauguauuuaa

SEQ ID NO: 35989 - RNA, 1701 nt, Artificial Sequence
  hemagglutinin__InfluenzaA__ADL32554
augaaggcaauacuaguaguucugcuauauacauuuguaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggaauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacuugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35990 - RNA, 1701 nt, Artificial Sequence
  hemagglutinin__InfluenzaA__ADL32670
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagauuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacaucaaugauaaagggaaagaaguccucgugcuauggggcauucaccauccaucuacuagugcugaccaacaaagucucuaucagaaugcagauucauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35991 - RNA, 1701 nt, Artificial Sequence
  hemagglutinin__InfluenzaA__ADL32690
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauguggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauucauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagaugggugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggauauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35992 - RNA, 1701 nt, Artificial Sequence
  hemagglutinin__InfluenzaA__ADL32710
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauucauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagaugggugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggauauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35993 - RNA, 1701 nt, Artificial Sequence
  hemagglutinin__InfluenzaA__ADL32720
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagggggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35994 - RNA, 1701 nt, Artificial Sequence
  hemagglutinin__InfluenzaA__ADL32730
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaaaagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaaaauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaagggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35995 - RNA, 1701 nt, Artificial Sequence
  hemagglutinin__InfluenzaA__ADL32740
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaaaagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaaaauacagcaagaaguucaagccagaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguuuaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35996 - RNA, 1701 nt, Artificial Sequence
  hemagglutinin__InfluenzaA__ADL39137
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucccuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauauccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggauucaucaugugggccugccaaaaaggcaacauuaggugcaacauuugcauuuga

SEQ ID NO: 35997 - RNA, 1698 nt, Artificial Sequence
  hemagglutinin__InfluenzaA__ADL39148
augaaaguaaaacuacugguccuguuaugcacauuuacagcuacauaugcagacacaauauguauaggcuaccaugcuaacaacucgaccgacacuguugacacaguacuugaaaagaaugugaccgugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaguugaccaaaagacccucuaucguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagagauuuuggaucaggaaucaucaacucaaaugcaccaauggauaaaugugaugcgaaaugucaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaauuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 35998 - RNA, 1701 nt, Artificial Sequence
  hemagglutinin__InfluenzaA__ADL39159
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaagucacuaaugcuacugagcugguucagaguuccucaacaggugaaauaugcgacaguccucaucagaucauugauggagaaaacugcacacuaauagaugcucuauugggagacccucagugugauggcuuccaaaauaagaaaugggaccuuuuuguugaacgaagcaaagccuacagcaacuguuauccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaguucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaagaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguuuugcuuuguugggguucaucaugugggccugccaaaaaggcaacauuaggugcaacauuugcauuuga

SEQ ID NO: 35999 - RNA, 1701 nt, Artificial Sequence
  hemagglutinin__InfluenzaA__ADL39170
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacugugccaaacaaugaacaauuugacaaauuguacauuugggggguucaccacccggguacggacaaagaccaaaucuuccuguaugcucaagcaucaggaagaaucacagucucuaccaaaagaagccaacaaaccguaaucccgaauaucggaucuagacccagaguaaggaauaucccuagcagaauaagcaucuauuggacaauaguaaaaccgggagacguacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugaggggagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 36000 - RNA, 1701 nt, Artificial Sequence
  hemagglutinin__InfluenzaA__ADL39203
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucccuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 36001 - RNA, 1701 nt, Artificial Sequence
  hemagglutinin__InfluenzaA__ADL39214
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagauccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaauuccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 36002 - RNA, 1698 nt, Artificial Sequence
  hemagglutinin__InfluenzaA__ADL39225
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccaggguauuucgccgacuaugaggagcugagagagcaauugaguucaguaucuucauuugagagguucgaaauauuccccaaagaaagcucauggcccaaccacaccguaaccggagcgucagcaucaugcucccauaauggggaaaacaguuuuuacagaaauuugcuauggcugacggggaagaaugguuuguacccaaaccugagcaaguccuaugcaaacaacaaagaaaaagaaguccuuguacuaugggguguucaucacccgccaaacauagcugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguaggggcuuuggaucaggaaucaucaacucaaaugcaccaauggauaaaugugaugcgaagugccaaacaccucaaggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36003 - RNA, 1698 nt, Artificial Sequence
  hemagglutinin__InfluenzaA__ADL39236
augaaaguaaaacuacugguccuguuaugcacauuuacagcuacguaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaagagucaugguccuacauuguagaaaaaccaaauccugagaauggaacauguuacccaggguauuucgccgacuaugaggagcugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuauacaaacaacaaagaaaaagaaguccuuguacuaugggguguucaucacccgccaaacauaguugaccaaaagacccucuaccguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggguaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36004 - RNA, 1701 nt, Artificial Sequence
  hemagglutinin__InfluenzaA__ADL39280
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucaucuggcacacuggaguuuaacaaugaaagcuucaauuggacuggagucacucaaaacggaacaagcucugcuugcauaaggagaucuaauaacaguuucuuuaguagauugaauugguugacccacuuaagauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacagaaucacauacggggccugucccagauauguuaagcaaaacacucugaaauuggcaacagggaugcgaaauguaccagagaaacaaacuagaggcauauuuggagcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugauucagaaaugaacaaacuguuugaaaaaacaaagaagcaacugagggaaaaugcugaagauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 36005 - RNA, 1698 nt, Artificial Sequence
  hemagglutinin__InfluenzaA__ADL39291
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggagaagaaugguuuguacccaaaccugagcaaguccuaugcaaacaacaaagaaaaagaaguccuuguacuaugggguguucaucacccgccaaacaugggugaccaaaagacccucuaucauacagaaaaugcuuauguuucuguagugucuucacauuauagcagaaaauucaccccagaaauagccaaaagacccaaaguaagagaccaagaaggaagaaucaacuacuacuggacucugcuugaacccggggauacaauaauauuugaggcaaauggaaaucuaauagcgccaagauaugcuuucgcacuaaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagauauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36006 - RNA, 1701 nt, Artificial Sequence
  hemagglutinin__InfluenzaA__ADL39302
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggaccggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaacucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgguaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 36007 - RNA, 1701 nt, Artificial Sequence
  hemagglutinin__InfluenzaA__ADL39313
augaagacuaucauugcuuugagcuacauucuaugucugguuuucgcucaaaaacuuccuggaaaugacaacagcacggcaacgcugugccuugggcaccaugcaguaccaaacggaacaauagugaaaacaaucacgaaugaccaaauugaaguuacuaaugcuacugagcugguucagaguuccucaacaggugaaauaugcgacaguccucaucagauccuugauggagagaacugcacacuaauagaugcucuauugggagacccucaaugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaagauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauuccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguuaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugaaggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 36008 - RNA, 1701 nt, Artificial Sequence
  hemagglutinin__InfluenzaA__ADL39335
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucaucuggcacacuggaguuuaacaaugaaagcuucaauuggacuggagucacucaaaacggaacaagcucugcuugcauaaggagaucuaauaacaguuucuuuaguagauugaauugguugacccacuuaagauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacagaaucacauacggggccugucccagauauguuaagcaaaacacucugaaauuggcaacagggaugcgaaauguaccagagaaacaaacuagaggcauauuuggagcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauucaucuaacugacucagaaaugaacaaacuguuugaaaaaacaaagaagcaacugagggaaaaugcugaagauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 36009 - RNA, 1701 nt, Artificial Sequence
  hemagglutinin__InfluenzaA__ADL39368
augaagacuaucauugcuuugagcuacauucuaugccuaguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauuaaacgugacuaugccaaacaaugaacaauuugacaaauuguacauuugggggguucaccacccggguacggacaaugaccaaaucuuccuguaugcucaagcaucaggaagaaucacagucucuacaaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugagugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcgggcuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 36010 - RNA, 1698 nt, Artificial Sequence
  hemagglutinin__InfluenzaA__ADL39390
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaagagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucacauaauggggaaagcaguuuuuacagaaauuugcuauggcugacggggaagaaugguuuguacccaagccugagcaaguccuaugcaaacaacaaagaaaaagaaguccuuguacuaugggguguucaucacccgccaaacauaguugaccaaaagacccucuaccguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggguaaaugugaugcgaagugucaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36011 - RNA, 1701 nt, Artificial Sequence
  hemagglutinin__InfluenzaA__ADL39401
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucuucuugcaugaggagaucuaauaacaguuucuuuaguagauugaauugguugacccacuuaaaauucaaauacccagcauuaaacgugacuaugccaaacaaugaacaauuugacaaauuguacauuugggggguucaccacccggguacggacaaugaccaaaucuuccuguaugcucaagcaucaggaagaaucacagucucuacaaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggugcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 36012 - RNA, 1701 nt, Artificial Sequence
  hemagglutinin__InfluenzaA__ADL39412
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauuaaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugagaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 36013 - RNA, 1698 nt, Artificial Sequence
  hemagglutinin__InfluenzaA__ADL39423
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccaggacauuucgcugacuaugaggaacugagggagcaauugaguucaguaucuucauuugagagguucgaaauauuccccaaagaaagcucauggcccagccacaccguaaccggagugucagcaucaugcucccauaauggggaaaacaguuuuuacagaaauuugcuauggcugacggggaagaaugguuuguacccaaaccugagcaaguccuaugcaaacaacaaagaaaaagaaguccuuguacuaugggguguucaucacccgccaaacauagcugaccaaaagacccucuaccauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaaugggaaucuaauagcgccaagauaugcuuucgcacugaguagaggcuuuggaucaggaaucaucaacucaaaugcaccaauggauaaaugugaugcgaagugucaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaaaccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36014 - RNA, 1701 nt, Artificial Sequence
  hemagglutinin__InfluenzaA__ADL39434
augaagacuaucauugcuuugagcuacauucuaugucugguuuucgcucaaaaacuuccuggaaaugacaacagcacggcaacgcugugccuugggcaccaugcaguaccaaacggaacaauagugaaaacaaucacgaaugaccaaauugaaguuacuaaugcuacugagcugguucagaguuccucaacaggugaaauaugcgacaguccucaucagauccuugauggagagaacugcacacuaauagaugcucuauugggagacccucaaugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaagauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaagggauauuccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguuaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugaaggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 36015 - RNA, 1698 nt, Artificial Sequence
  hemagglutinin__InfluenzaA__ADL39445
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaagagucauggucauacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaacccugagcaaguccuaugcaaacaacaaagaaaaagaaguccuuguacuaugggguguucaucacccgccaaacauaguugaccaaaagacccucuaucguacagaaaaugcuuauguuucuguagugucuucacauuauagcagaaaauucaccccagaaauagccaaaagacccaaaguaagagaucaagaaggaagaaucaacuacuacuggacucugcuugaacccggagauacaauaauauuugaggcaaauggaaaucuaauagcgccaagauaugcuuucgcacugaguagaggcuuuggaucaggaaucaucaacucaaaugcaccaauggauaaaugugaugcgaagugucaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36016 - RNA, 1698 nt, Artificial Sequence
  hemagglutinin__InfluenzaA__ADL39456
augaaaguaaaacuacugguccuguuaugcacauuuacagcuacauaugcagacacaauauguauaggcuaccaugcuaacaacucgaccgauacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccagccacaccguaaccggagugucagcaucaugcucccauaauggggaaaacaguuuuuacagaaauuugcuauggcugacggggaagaaugguuuguacccaaaccugagcaaguccuaugcaaacaacaaagaaaaagaaguccuuguacuaugggguguucaucacccgccaaacauagcugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugucaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaacggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36017 - RNA, 1698 nt, Artificial Sequence
  hemagglutinin__InfluenzaA__ADL39467
augaaaguaaaacuacugguccuguuaugcacauuuacagcuacauacgcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaagagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaguugaccaaaagacccucuaccguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggguaaaugugaugcgaagugucaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36018 - RNA, 1701 nt, Artificial Sequence; identical to SEQ ID NO: 33206
  hemagglutinin__InfluenzaA__ADL41164

SEQ ID NO: 36019 - RNA, 1701 nt, Artificial Sequence; identical to SEQ ID NO: 33266
  hemagglutinin__InfluenzaA__ADL41173

SEQ ID NO: 36020 - RNA, 1698 nt, Artificial Sequence
  hemagglutinin__InfluenzaA__ADL60242
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacugugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggagcugagggagcaauugaguucaguaucuucauuugagagguucgaaauauuccccaaagaaagcucauggcccaaccacaccguaaccggagugucagcaucaugcucccauaauggggaaagaaguuuuuacagaaauuugcuauggcugacggggaagaaugguuuguacccaaaccugagcaaguccuaugcaaacaacaaagaaaaagaaguccuuguacuaugggguguucaucacccgccagacauagguaaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugucaaacaccucagggagcuauaaacagcagucuuccuuuccagaacguacacccagucacaauaggagaguguccaaaguaugucaggagugcaaaauuaaggaugguuacaggacuaagaaacaucccauccauucaauccagagguuuguuuggagccauugccgguuucauugaagggggguggacuggaaugguagaugguugguaugguuaucaucaucagaaugagcaagggucuggcuaugcugcagaucaaaaaagcacacaaaaugccaucaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugauuccaaugugaagaaucuguaugagaaaguaaaaagccaguuaaagaauaaugcuaaagaaauaggaaauggguguuuugaauucuaucacaaguguaacgaugagugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36021 - RNA, 1698 nt, Artificial Sequence
  hemagglutinin__InfluenzaA__ADL60253
augaaaguaaaacuacugguccuguuaugcacauuuacagcuacauaugcagacacaauauguauaggcuaccaugcuaacaacucaaccgacacuguugacacaguacuugaaaagaaugugacagugacacauucugucaaccugcuugagaacagucacaauggaaaacuaugucuauuaaaaggaauagccccacuacaauuggguaauugcagcguugccggauggaucuuaggaaacccagaaugcggauuacugauuuccaaggagucaugguccuacauuguagaaaaaccaaacccugagaauggaacauguuacccaggguauuucgccgacuaugaggagcugagggagcaauugaguucaguaucuucauuugagagguucgaaauauuccccaaagaaagcucauggcccaaccacaccguaaccggagugucagcaucaugcucccauaauggagaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauagguaaccaaaaggcccucuaucauacagaaaaugcuuauguuucuguagugucuucacauuauagcagaaaauucaccccagaaauagccaaaagacccaaaguaagagaucaagaaggaagaaucaacuacuacuggacucuacuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugucaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggggugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36022 - RNA, 1698 nt, Artificial Sequence
  hemagglutinin__InfluenzaA__ADL60264
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacugugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggagcugagggagcaauugaguucaguaucuucauuugagagguucgaaauauuccccaaagaaagcucauggcccaaccacaccguaaccggagugucagcaucaugcucccauaauggggaaagaaguuuuuacagaaauuugcuauggcugacggggaagaaugguuuguacccaaaccugagcaaguccuaugcaaacaacaaagaaaaagaaguccuuguacuaugggguguucaucacccgccagacauagguaaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugucaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaagggucuggcuaugcugcagaucaaaaaagcacacaaaaugccaucaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggaccuauaaugcagaacuguugguucuacuggaaaaugaaaggacuuuggauuuccaugauuccaaugugaagaaucuguaugagaaaguaaaaagccaguuaaagaauaaugcuaaagaaauaggaaacggguguuuugaauucuaucacaaguguaacgaugagugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36023 - RNA, 1698 nt, Artificial Sequence
  hemagglutinin__InfluenzaA__ADL60275
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacugugucuauuaaaaggaauagccccacuacaguuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagaaguuuuuacagaaauuugcuauggcugacggggaagaaugguuuguacccaaaccugagcaaguccuaugcaaacaacaaagaaaaagaaguccuuguacuaugggguguucaucacccgccagacauagguaaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugucaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccaucaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugauuccaaugugaagaaucuguaugagaaaguaaaaagccaguuaaagaauaaugcuaaagaaauaggaaauggguguuuugaauucuaucacaaguguaacgaugagugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36024 - RNA, 1698 nt, Artificial Sequence
  hemagglutinin__InfluenzaA__ADL60286
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggagcugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaagcauaaguaaucaaaagacccucuaucauacagaaaaugcuuauguuucuguagugucuucacauuauagcagaaaauucaccccagaaguagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugucaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagacgguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaacgcagaacuguugguucuacuggaaaaugaaaggacuuuggauuuccaugacuccaaugugaagaaucuguaugagaaaguaaaaagccaguuaaagaauaaugcuaaagaaauaggaaacggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36025 - RNA, 1698 nt, Artificial Sequence
  hemagglutinin__InfluenzaA__ADL60297
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcgucgccggguggaucuuaggaaacccagaaugcgaauuacugauuuccaaggagucaugguccuacauuguagaaaaaccaaauccugagaauggaacauguuacccagggcauuucgcugacuaugaggagcugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacgaggaagaaugguuuguacccaaaccugagcaaguccuaugcaaacaacaaggaaaaagaaguccuuguacuaugggguguucaucacccgccaaacauaggugaccaaaagacccucuaucauacagaaaaugcuuauguuucuguagugucuucacauuauagcagaaaauucaccccagaaauagccaaaagacccaaaguaagagaucaagaaggaaggaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugucaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggaccuauaacgcagaacuguugguucuacuggaaaaugaaaggacuuuggauucccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacggucgccaguucucugguucuuuuggucucccugggggcaaucagcuucuggauguguuccaaugggucuuugcaguguagaauaugcaucuaa

SEQ ID NO: 36026 - RNA, 1698 nt, Artificial Sequence
  hemagglutinin__InfluenzaA__ADL60308
augaaaguaaaacuacugguccuguuaugcacauuugcagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcguugccggguggaucuuaggaaacccagaaugcgaauugcugauuuccaaggagucaugguccuacauuguagaaaaaccaaauccugagaauggaacauguuacccagggcauuucgcugacuaugaggagcugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacgggaaagaaugguuuguacccaaaccugagcaaguccuaugcaaacaacaaagaaaaagaaguccuuguacuaugggguguucaucacccgccaaacauagguguccaaaaggcccucuaucauacagaaaaugcuuaugucucuguagugucuucacauuauagcagaaaauucaccccagaaauagccaaaagacccaaaguaagagaucaagaaggaagaaucaauuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugucaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauacuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36027 - RNA, 1698 nt, Artificial Sequence
  hemagglutinin__InfluenzaA__ADL60341
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucguuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauagguguccaaaaggcccucuaucauacagaaauugcuuaugucucuguagugucuucacauuauagcagaaaauucaccccagaaauagccaagagacccaaaguaagagaucaagaaggaagaaucaacuacuacuggacuauacuugaacccggggauacuauaauauuugaggcaaauggaaaucuaauagcgccaagauaugcuuucgcacugaguagaggcuuuggaucaggaaucaucaacucaaaugcuccaauggauaaaugugaugcgaagugucaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuagcgaucuacucaacagucgccaguucucugguucuuuuggucucccugggggcaaucagcuucuggauguguuccaaugggucuuugcaguguagaauaugcaucuaa

SEQ ID NO: 36028 - RNA, 1698 nt, Artificial Sequence
  hemagglutinin__InfluenzaA__ADL60352
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacugugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgccggcuaugaggagcugagggagcaauugaguucaguaucuucauuugagagguucgaaauauuccccaaagaaagcucauggcccaaccacaccguaaccggagugucagcaucaugcucccauaauggggaaagaaguuuuuacagaaauuugcuauggcugacggggaagaaugguuuguacccaaaccugagcaaguccuaugcaaacaacaaagaaaaagaaguccuuguacuaugggguguucaucacccgccagacauagguaaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugucaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaagggucuggcuaugcugcagaucaaaaaagcacacaaaaugccaucaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggaccuauaacgcagaacuguugguucuacuggaaaaugaaaggacuuuggauuuccaugauuccaaugugaagaaucuguaugagaaaguaaaaagccaguuaaagaauaaugcuaaagaaauaggaaacggguguuuugaauucuaucacaaguguaacgaugagugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36029 - RNA, 1701 nt, Artificial Sequence
  hemagglutinin__InfluenzaA__ADL60363
augaagacuaucauugcuuugagcuacauucuaugucugguuuucgcucaaaaauuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaauugggaccuuuuuguugaacgcagcaaagccuacagcaacuguuacccuuaugaugugccggauuaugccucccuuaggucacuaauugccucauccggaacacuggaguuuaacaaugaaagcuucaauuggacuggagucacucaaaacggaacaagcucugcuugcauaaggagaucuaauaacaguuucuuuaguagauugaauugguugacccacucaaaauucaaauacccagcacugaacgugacuaugccaaacaaugaaaauuuugacaaauuguacauuugggggguucaccacccggguacggacaaugaccaaaucuuccuguaugcucaagcaucaggacgaaucacaaucucuaccaaaagaagccaacaaacuguaaucccgaauaucggaucuagacccagaguaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaaucgcugguuucauagaaaaugguugggagggaaugguggaugguugguacgguuucaggcaucaaaauucugagggaguaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugauucagaaaugaacaaacuguuugaaaaaacaaagaagcaacugagggaaaaugcugaggauaugggcaaugguuguuucaaaaucuaccacaaaugugacaaugccugcauaggaucaaucagaaauggaacuuaugaccacgaugucuacagagaugaagcauuaaacaaccgguuccagaucaagggcguugagcugaagucaggauacaaagauuggauccuauggauuuccuuugccauaucauguuuuuugcuuugcauugcuuuguugggguucaucaugugggccugccaaaaaggcaacauuaggugcaacauuugcauuuga

SEQ ID NO: 36030 - RNA, 1698 nt, Artificial Sequence
  hemagglutinin__InfluenzaA__ADL60374
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccaugauggggaaaguaguuuuuacagaaauuuacuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuauguuucuguggugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugucaaacaccucagggagcuauaaacagcagucuuccuuuccagaacguacacccagucacaauaggagaguguccaaaguaugucaggagugcaaaauuaagggugguuacaggacuaaggaacauuccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcugugggcaaagaauucaacaaauuggaaagaaggauggaaaacuugaauaaaaaaguugaugauggguuuauagacaucuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36031 - RNA, 1701 nt, Artificial Sequence
  hemagglutinin__InfluenzaA__ADM07135
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugaaucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggggacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36032 - RNA, 1701 nt, Artificial Sequence; identical to SEQ ID NO: 33658
  hemagglutinin__InfluenzaA__ADM07144

SEQ ID NO: 36033 - RNA, 1701 nt, Artificial Sequence
  hemagglutinin__InfluenzaA__ADM07154
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaccuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaaugguaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36034 - RNA, 1701 nt, Artificial Sequence; identical to SEQ ID NO: 33658
  hemagglutinin__InfluenzaA__ADM07163

SEQ ID NO: 36035 - RNA, 1698 nt, Artificial Sequence
  hemagglutinin__InfluenzaA__ADM07460
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaagagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaguugaccaaaagacccucuaccguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggguaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36036 - RNA, 1701 nt, Artificial Sequence
  hemagglutinin__InfluenzaA__ADM07504
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaauuucaaauacccagcauugaacgugacuaugccaaacaaugaacaauuugacaaacuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaaaugggaaaagcucaauaaugagaucagaugcacccauuggcaagugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucggaaaaaccaacgagaaauuccaucagauugaaaaagaauucucagaagucgaagggagaauucaggaccuugagaaauauguugaggacacuaaaauagaucucuggucauacaacgcggagcuucuuguugcccuugagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 36037 - RNA, 1701 nt, Artificial Sequence
  hemagglutinin__InfluenzaA__ADM12806
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaaguggaaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucacaauauaccacaaaugugacaaugccugcauaggaucaaucagaaauggaacuuaugaccacaauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 36038 - RNA, 1701 nt, Artificial Sequence; identical to SEQ ID NO: 36037
  hemagglutinin__InfluenzaA__ADM12817

SEQ ID NO: 36039 - RNA, 1701 nt, Artificial Sequence
  hemagglutinin__InfluenzaA__ADM12828
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggauuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaaguggaaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucacaauauaccacaaaugugacaaugccugcauaggaucaaucagaaauggaacuuaugaccacaauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 36040 - RNA, 1701 nt, Artificial Sequence; identical to SEQ ID NO: 36037
  hemagglutinin__InfluenzaA__ADM12839

SEQ ID NO: 36041 - RNA, 1701 nt, Artificial Sequence
  hemagglutinin__InfluenzaA__ADM12850
augaaggcuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaaguggaaaaagcucaauaaugagaucagaugcacccauuggcaaaugcaauucugaaugcaucacuccaaauggaagcauucccaaugacaaaccauuccaaaauguaaacaggaucacauacggggccugccccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucacaauauaccacaaaugugacaaugccugcauaggaucaaucagaaauggaacuuaugaccacaauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 36042 - RNA, 1701 nt, Artificial Sequence; identical to SEQ ID NO: 33955
  hemagglutinin__InfluenzaA__ADM12861

SEQ ID NO: 36043 - RNA, 1701 nt, Artificial Sequence; identical to SEQ ID NO: 33955
  hemagglutinin__InfluenzaA__ADM12871

SEQ ID NO: 36044 - RNA, 1701 nt, Artificial Sequence
  hemagglutinin__InfluenzaA__ADM12881
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaggggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaacacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36045 - RNA, 1701 nt, Artificial Sequence; identical to SEQ ID NO: 34493
  hemagglutinin__InfluenzaA__ADM12891

SEQ ID NO: 36046 - RNA, 1701 nt, Artificial Sequence; identical to SEQ ID NO: 33801
  hemagglutinin__InfluenzaA__ADM12901

SEQ ID NO: 36047 - RNA, 1701 nt, Artificial Sequence
  hemagglutinin__InfluenzaA__ADM12911
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucaggcaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaacucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagaaccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36048 - RNA, 1701 nt, Artificial Sequence; identical to SEQ ID NO: 33173
  hemagglutinin__InfluenzaA__ADM12921

SEQ ID NO: 36049 - RNA, 1701 nt, Artificial Sequence; identical to SEQ ID NO: 33173
  hemagglutinin__InfluenzaA__ADM12931

SEQ ID NO: 36050 - RNA, 1701 nt, Artificial Sequence
  hemagglutinin__InfluenzaA__ADM12941
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguaucuaa

SEQ ID NO: 36051 - RNA, 1701 nt, Artificial Sequence
  hemagglutinin__InfluenzaA__ADM12951
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggagcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguaucuaa

SEQ ID NO: 36052 - RNA, 1701 nt, Artificial Sequence
  hemagglutinin__InfluenzaA__ADM12961
augaaggcaguacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaggagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuaccccaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36053 - RNA, 1701 nt, Artificial Sequence
  hemagglutinin__InfluenzaA__ADM12971
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacgaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaaguguaaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36054 - RNA, 1701 nt, Artificial Sequence
  hemagglutinin__InfluenzaA__ADM12981
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggaucuugggaaauccagagugcgaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggagauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36055 - RNA, 1701 nt, Artificial Sequence
  hemagglutinin__InfluenzaA__ADM12991
augaaggcaauacuaguaguucugcuauauacauuugaaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggaauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagaucacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacaugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36056 - RNA, 1701 nt, Artificial Sequence
  hemagglutinin__InfluenzaA__ADM13001
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggaauucaccauccaucuacuagugcugaccaacaaagucucuaucagaaugcagaugcauauguuuuuguggggacaucaagauacagcaagaaguucaagccugaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaagugaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36057 - RNA, 1701 nt, Artificial Sequence
  hemagglutinin__InfluenzaA__ADM13011
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaacugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36058 - RNA, 1701 nt, Artificial Sequence
  hemagglutinin__InfluenzaA__ADM13021
augaaggcaauacuaguaguucugcuauauacauuugcaaccgcaaaugcagacacauuauguauagguuaucaugcgaacaauucaacagacacuauagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuucccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaucugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36059 - RNA, 1701 nt, Artificial Sequence; identical to SEQ ID NO: 35264
  hemagglutinin__InfluenzaA__ADM13031

SEQ ID NO: 36060 - RNA, 1701 nt, Artificial Sequence
  hemagglutinin__InfluenzaA__ADM13041
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaaaggugcuauaaacaccagccucccauuucagaauguacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36061 - RNA, 1701 nt, Artificial Sequence
  hemagglutinin__InfluenzaA__ADM13051
augaaggcaauacuaguaguucugcuauauacauuugcaaccacaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacgucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36062 - RNA, 1701 nt, Artificial Sequence
  hemagglutinin__InfluenzaA__ADM13061
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggauagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaucuugucagacacccaagggugcuauaaacaccagccucccauuucagaauauacauccgaucacaauuggaaaauguccaaaauauguaaaaagcacaaaauugagacuggccacaggauugaggaaugucccguccauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36063 - RNA, 1701 nt, Artificial Sequence
  hemagglutinin__InfluenzaA__ADM13071
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggauagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguucucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36064 - RNA, 1701 nt, Artificial Sequence
  hemagglutinin__InfluenzaA__ADM13081
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggauagccccauugcauuuggguaaauguaacauugcuggcuggauccugggaaauccagagugugaaucacucuccacagcaagcucaugguccuacauuguggaaacaucugguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagagaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36065 - RNA, 1701 nt, Artificial Sequence
  hemagglutinin__InfluenzaA__ADM13091
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggaauucaccauccaucuacuagugcugaccaacaaagucucuaucagaacgcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36066 - RNA, 1701 nt, Artificial Sequence; identical to SEQ ID NO: 35343
  hemagglutinin__InfluenzaA__ADM13101

SEQ ID NO: 36067 - RNA, 1701 nt, Artificial Sequence
  hemagglutinin__InfluenzaA__ADM13111
augaaggcaauacuaguaguucugcuauauacauuugaaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauaugucuuuguggggacaucaagauacagcaagaaguucaagccggaaauagcaauaagacccaaagugagggaucaagaagggagaaugaacuauuacuggacacuaguagauccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaauggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36068 - RNA, 1701 nt, Artificial Sequence
  hemagglutinin__InfluenzaA__ADM13121
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcaugcccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugcugaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36069 - RNA, 1701 nt, Artificial Sequence
  hemagglutinin__InfluenzaA__ADM13131
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacgaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaagaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36070 - RNA, 1701 nt, Artificial Sequence
  hemagglutinin__InfluenzaA__ADM13141
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaauggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagaucacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36071 - RNA, 1701 nt, Artificial Sequence
  hemagglutinin__InfluenzaA__ADM13151
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaauggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagaucacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucuccuugggggcaaucaguuucuggaugugcucuaaugggucucuacaguguagaauauguauuuaa

SEQ ID NO: 36072 - RNA, 1701 nt, Artificial Sequence
  hemagglutinin__InfluenzaA__ADM13161
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccuagugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaacucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagagauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36073 - RNA, 1701 nt, Artificial Sequence; identical to SEQ ID NO: 34822
  hemagglutinin__InfluenzaA__ADM13171

SEQ ID NO: 36074 - RNA, 1701 nt, Artificial Sequence; identical to SEQ ID NO: 34822
  hemagglutinin__InfluenzaA__ADM13181

SEQ ID NO: 36075 - RNA, 1701 nt, Artificial Sequence
  hemagglutinin__InfluenzaA__ADM13191
augaaggcaauacuaguaguucugcuauauacacuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauuaagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggaauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugaggcuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36076 - RNA, 1701 nt, Artificial Sequence
  hemagglutinin__InfluenzaA__ADM13211
augaaggcaauacuaguaguucugcuauauacacuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggauagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36077 - RNA, 1701 nt, Artificial Sequence; identical to SEQ ID NO: 36076
  hemagglutinin__InfluenzaA__ADM13221

SEQ ID NO: 36078 - RNA, 1701 nt, Artificial Sequence
  hemagglutinin__InfluenzaA__ADM13231
augaaggcaauacuaguaguucugcuauauacauuugaaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaauggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36079 - RNA, 1701 nt, Artificial Sequence; identical to SEQ ID NO: 35343
  hemagglutinin__InfluenzaA__ADM13241

SEQ ID NO: 36080 - RNA, 1701 nt, Artificial Sequence
  hemagglutinin__InfluenzaA__ADM13251
augaaggcaauacuaguaguucugcuauauacauuugcaaccacaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacgucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagagaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36081 - RNA, 1701 nt, Artificial Sequence
  hemagglutinin__InfluenzaA__ADM13261
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggauagccccauugcauuuggguaaauguaacauugcuggcuggauccugggaaauccagagugugaaucacucuccacagcaagcucaugguccuacauuguggaaacaucugguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucuggcauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36082 - RNA, 1701 nt, Artificial Sequence
  hemagglutinin__InfluenzaA__ADM13271
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacgucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauucaccagauuuuggcgaucuauucaacugucgccaguucauugguacugguagucucccugggggcaaucaguuucuggaugugcucuaaugggucucuacaguguagaauauguauuuaa

SEQ ID NO: 36083 - RNA, 1701 nt, Artificial Sequence; identical to SEQ ID NO: 36078
  hemagglutinin__InfluenzaA__ADM13281

SEQ ID NO: 36084 - RNA, 1701 nt, Artificial Sequence
  hemagglutinin__InfluenzaA__ADM13291
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaaggcaaagaaguccucgugcuauggggcauucaccauccaucuacuagugcugaccaacaaagucuuuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36085 - RNA, 1701 nt, Artificial Sequence
  hemagglutinin__InfluenzaA__ADM13301
augaaggcaauacuaguaguucugcuauauacauuugcaaccgcaaaugcagacacauuauguauagguuaucaugcgaacaauucaacagacacuguagacacaauacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaagaaaauucauacccaaagcucagcaaauccuacauuaaugacaaagggaaagaaguccucgugcuauggggcauucaccauccaucuacuagugcugaccaacaaagucucuaucagaauguagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauuugcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaauuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaauagagaagaaauagaugggguaaagcuggaaucaacaaggauuuaccagauuuuggcgaucuauucaacugucgccaguucauugguacugguagucucccugggggcaaucaguuucuggaugugcucuaaugggucuuuacaguguagaauauguauuuaa

SEQ ID NO: 36086 - RNA, 1701 nt, Artificial Sequence
  hemagglutinin__InfluenzaA__ADM13311
augaaggcaauacuaguaguucugcuauauacauuugcaaccgcaaaugcagacacauuauguauagguuaucaugcgaacaauucaacagacacuguagacacaauacuagaaaagaauguaacaguaacacacucuguuaaccuucuagaaaacaagcauaacgggaaacuaugcaaacuaagagggguauccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggauggacagguaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuucuggaugugcucuaaugggucucuacaguguagaauauguauuuaa

SEQ ID NO: 36087 - RNA, 1701 nt, Artificial Sequence
  hemagglutinin__InfluenzaA__ADM13321
augaaggcaauacuaguaguucugcuauauacauuugcaacagcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauauagcaagaaguucaagccggaaauagcaauaagacccaaagugagggaucaagaagggagaaugaacuacuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuaccccaaauacucagaggaagcaaaauuaaacagagaagaaauagauggggugaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36088 - RNA, 1701 nt, Artificial Sequence
  hemagglutinin__InfluenzaA__ADM13331
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccgaucaugacucgaacaaagguguaacggcagcauguccucaugcuggagcaaaaagcuucuacaaaaauuuaauauggcuaguuaaaaaaggaaauucauacccaaagcucagcaaauccuauauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36089 - RNA, 1701 nt, Artificial Sequence
  hemagglutinin__InfluenzaA__ADM13341
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacaucaaugauaaagggaaagaaguccucgugcuauggggcauucaccauccaucuacuagugcugaccaacaaagucucuaucagaaugcagauucauauguuuuuguggggacaucaagauacagcaagaaauucaaaccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacaucuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36090 - RNA, 1701 nt, Artificial Sequence
  hemagglutinin__InfluenzaA__ADM13351
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcaugcccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauaugcuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguuuuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagagauagaugggguaaagcuggaaucaacaaggauuuaccagauuuuggcgaucuauucaacugucgccaguucuuugguacugguagucucccugggggcaaucaguuucuggaugugcucuaaugggucucuacaguguagaauauguauuuaa

SEQ ID NO: 36091 - RNA, 1701 nt, Artificial Sequence; identical to SEQ ID NO: 32911
  hemagglutinin__InfluenzaA__ADM13442

SEQ ID NO: 36092 - RNA, 1701 nt, Artificial Sequence; identical to SEQ ID NO: 32909
  hemagglutinin__InfluenzaA__ADM13443

SEQ ID NO: 36093 - RNA, 1701 nt, Artificial Sequence; identical to SEQ ID NO: 32908
  hemagglutinin__InfluenzaA__ADM13444

SEQ ID NO: 36094 - RNA, 1701 nt, Artificial Sequence; identical to SEQ ID NO: 33780
  hemagglutinin__InfluenzaA__ADM13445

SEQ ID NO: 36095 - RNA, 1701 nt, Artificial Sequence; identical to SEQ ID NO: 32904
  hemagglutinin__InfluenzaA__ADM13446

SEQ ID NO: 36096 - RNA, 1701 nt, Artificial Sequence
  hemagglutinin__InfluenzaA__ADM13447
augaagaccaucauugcuuugagcuacauuuucugucuggcucucggccaagaccuuccaggaaaugacaacagcacagcaacgcugugccugggacaucaugcggugccaaacggaacacuagugaaaacaaucacagaugaucagauugaagugacuaaugcuacugagcuaguucagagcuccucaacggggaaaauaugcaacaauccucaucgaauccuugauggaauagacugcacacugauagaugcucuauugggggacccucauugugauguuuuucaaaaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauucagugcugaacgugacuaugccaaacaaugacaauuuugacaaacuauacauuugggggguucaccacccgagcacgaaccaagaacaaaccagccuguauguucaagcaucagggagagucacagucucuaccagaagaagccagcaaacuauaaucccgaauaucggguccagacccuggguaaggggucugucuaguagaauaagcaucuauuggacaauaguuaagccgggagacguacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaaggaggcaacugagggaaaaugcugaagacaugggcaaugguugcuucaaaauauaccacaaaugugacaacgcuugcauagagucaaucagaaaugggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 36097 - RNA, 1701 nt, Artificial Sequence; identical to SEQ ID NO: 32903
  hemagglutinin__InfluenzaA__ADM13448

SEQ ID NO: 36098 - RNA, 1701 nt, Artificial Sequence
  hemagglutinin__InfluenzaA__ADM13449
augaagaccaucauugcuuugagcuacauuuucugucuggcuuucggccaagaccuuccaggaaaugacaacagcacagcaacgcugugccugggacaucaugcggugccaaacggaacacuagugaaaacaaucacagaugaucagauugaagugacuaaugcuacugagcuaguucagagcuccucaacggggaaaauaugcaacaauccucaucgaauccuugauggaauagacugcacacugauagaugcucuauugggggacccucauugugauguuuuucaaaaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguucaagcaucagggagagucacagucucuaccaggagaagccagcaaacuauaaucccgaauaucgaguccagacccuggguaaggggucugucuaguagaauaagcaucuauuggacaauaguuaauccgggagacguacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaaggaggcaacugagggaaaaugcugaagacaugggcaaugguugcuucaaaauauaccacaaaugugacaacgcuugcauagagucaaucagaaaugggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 36099 - RNA, 1701 nt, Artificial Sequence; identical to SEQ ID NO: 32935
  hemagglutinin__InfluenzaA__ADM13450

SEQ ID NO: 36100 - RNA, 1701 nt, Artificial Sequence
  hemagglutinin__InfluenzaA__ADM13451
augaagaccaucauugcuuugagcuacauuuucugucuggcucucggccaagaccuuccaggaaaugacaacagaacagcaacgcugugccugggacaucaugcggugccaaacggaacacuagugaaaacaaucacagaugaucagauugaagugacuaaugcuacugagcuaguucagagcuccucaacggggaaaauaugcaacaauccucaucgaauccuugauggaauagacugcacacugauagaugcucuauugggggacccucauugugauguuuuucaaaaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguagugguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguucaagcaucagggagagucacagucucuaccaggagaagccagcaaacuauaaucccgaauaucggguccagacccuggguaaggggucugucuaguagaauaagcaucuauuggacaauaguuaagccgggagacguacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcaaccaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaaggaggcaacugagggaaaaugcugaagacaugggcaaugguugcuucaaaauauaccacaaaugugacaacgcuugcauagagucaaucagaaaugggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 36101 - RNA, 1701 nt, Artificial Sequence; identical to SEQ ID NO: 33664
  hemagglutinin__InfluenzaA__ADM13452

SEQ ID NO: 36102 - RNA, 1701 nt, Artificial Sequence
  hemagglutinin__InfluenzaA__ADM14467
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguucucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaguauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaaaaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36103 - RNA, 1695 nt, Artificial Sequence
  hemagglutinin__InfluenzaA__ADM14516
augaaggcaauacuaguaguucugcuauauacauuugcaaccgcaaaugcagacacauuauguauagguuaucaugcgaacaauucaacagacacuguaaacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuaguacugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuggucauagcuguagaauauguauuuaa

SEQ ID NO: 36104 - RNA, 1701 nt, Artificial Sequence
  hemagglutinin__InfluenzaA__ADM14525
augaaggcaacacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucauugucaucauuugaaagguuugagauauuccccaagacaaguucauggcccaaucaugacucaaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagacguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaacacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36105 - RNA, 1695 nt, Artificial Sequence
  hemagglutinin__InfluenzaA__ADM14553
augaaggcaauacuaguaguucugcuauauacauuugcaaccgcaaaugcagacacauuauguauagguuaucaugcgaacaauucaacagacacuguagacacaauacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggagacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaucaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacaggaaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuggucauagcuguagaauauguauuuaa

SEQ ID NO: 36106 - RNA, 1701 nt, Artificial Sequence
  hemagglutinin__InfluenzaA__ADM14562
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaggcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauucgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36107 - RNA, 1701 nt, Artificial Sequence; identical to SEQ ID NO: 33173
  hemagglutinin__InfluenzaA__ADM14571

SEQ ID NO: 36108 - RNA, 1701 nt, Artificial Sequence
  hemagglutinin__InfluenzaA__ADM14580
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaaaaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauaaaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36109 - RNA, 1701 nt, Artificial Sequence
  hemagglutinin__InfluenzaA__ADM14589
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaaaaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugggcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauaaaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36110 - RNA, 1701 nt, Artificial Sequence
  hemagglutinin__InfluenzaA__ADM14599
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauaguaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacgguugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36111 - RNA, 1701 nt, Artificial Sequence
  hemagglutinin__InfluenzaA__ADM14609
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauguuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucaaacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36112 - RNA, 1701 nt, Artificial Sequence
  hemagglutinin__InfluenzaA__ADM14618
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauaaccauccgaucacaauuggaaaauguccaaaauauguaaaaagcacaaaauugagacuagccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacgguugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36113 - RNA, 1701 nt, Artificial Sequence
  hemagglutinin__InfluenzaA__ADM14627
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaagggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36114 - RNA, 1701 nt, Artificial Sequence
  hemagglutinin__InfluenzaA__ADM14655
augaaggcaauacuaguaguucugcuauauacauuugcaaccgcaaaugcagacacguuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagccucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaagaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36115 - RNA, 1701 nt, Artificial Sequence
  hemagglutinin__InfluenzaA__ADM14664
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucuuuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccgguccacgauugcaauacaacuugucagacacccaauggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaacgagcaggggucaggauaugcagccgaccugaagagcacacagaaugccauugacgagaucacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36116 - RNA, 1701 nt, Artificial Sequence; identical to SEQ ID NO: 33173
  hemagglutinin__InfluenzaA__ADM14673

SEQ ID NO: 36117 - RNA, 1701 nt, Artificial Sequence; identical to SEQ ID NO: 33173
  hemagglutinin__InfluenzaA__ADM14682

SEQ ID NO: 36118 - RNA, 1701 nt, Artificial Sequence; identical to SEQ ID NO: 33173
  hemagglutinin__InfluenzaA__ADM14691

SEQ ID NO: 36119 - RNA, 1701 nt, Artificial Sequence
  hemagglutinin__InfluenzaA__ADM14700
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguugaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggcuugaggaaugucccgucuauucaaucuagaggccuauuuggggccauugccgguuucauugaagggggguggacaggaaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagauggggugaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36120 - RNA, 1695 nt, Artificial Sequence
  hemagglutinin__InfluenzaA__ADM14709
augaaggcaauacuaguaguucugcuauauacauuugcaaccgcaaaugcagacacauuauguauagguuaucaugcgaacaauucaacagacacuguagacacaguacuagaaaagaaugucacagugacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaauucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgggauuacuaacaaaauaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuugaacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuggucauagcuguagaauauguauuuaa

SEQ ID NO: 36121 - RNA, 1701 nt, Artificial Sequence
  hemagglutinin__InfluenzaA__ADM14718
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaaugggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucaaugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagccucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36122 - RNA, 1695 nt, Artificial Sequence
  hemagglutinin__InfluenzaA__ADM14728
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccuggggaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaacuccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacugguagagccgggagacaaaauaacauucgaagcaacuggaaaucuagugguaccgagauaugcauucgcaauggaaagaaaugcuggaucugguauuaucauuucagauacaccagcccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuggucauagcuguagaauauguauuuaa

SEQ ID NO: 36123 - RNA, 1701 nt, Artificial Sequence
  hemagglutinin__InfluenzaA__ADM14737
augaaggcaauacuaguaguucugcuauauacauuugcaaccgcaaaugcagacacauuauguauagguuaucaugcgaacaauucaacagacacuguaaacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagaccaaaagugagggaucaagaagggagaaugaacuauuacuggacacuaguagagccgggagacaaaauaacauucgaagcaacuggaaaucuagugguaccgagauaugcauucgcaauggaaaaaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaagagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36124 - RNA, 1701 nt, Artificial Sequence
  hemagglutinin__InfluenzaA__ADM14746
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggguccugggaaauccagagugugaaucacucuccacagcaagcucaugguccuacauuguggaaacaccuaguucagacaauggaacguguuacccaggagauuucaucgauuaugaagagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcaaaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36125 - RNA, 1695 nt, Artificial Sequence
  hemagglutinin__InfluenzaA__ADM14756
augaaggcaauacuaguaguucugcuauauacauuugcaaccgcaaaugcagacacauuauguguagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuggucauagcuguagaauauguauuuaa

SEQ ID NO: 36126 - RNA, 1701 nt, Artificial Sequence; identical to SEQ ID NO: 34337
  hemagglutinin__InfluenzaA__ADM14765

SEQ ID NO: 36127 - RNA, 1695 nt, Artificial Sequence
  hemagglutinin__InfluenzaA__ADM14775
augaaggcaauauuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucaacaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggagaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuagaaucaacaaggauuuaccagauuuuggcgaucuauucaacugucgccaguucauugguacugguagucucccugggggcaaucaguuucuggaugugcucuggucauagcuguagaauaugcauuuaa

SEQ ID NO: 36128 - RNA, 1695 nt, Artificial Sequence
  hemagglutinin__InfluenzaA__ADM14802
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaaauaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacaucaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccacuuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuggucauagcuguagaauauguauuuaa

SEQ ID NO: 36129 - RNA, 1704 nt, Artificial Sequence
  hemagglutinin__InfluenzaA__ADM14830
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaauuacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcugaaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaaauuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuggucauagcugucuacaguguagaauauguauuuaa

SEQ ID NO: 36130 - RNA, 1695 nt, Artificial Sequence
  hemagglutinin__InfluenzaA__ADM14848
augaaggcaauacuaguaguucugcuauauacauuugcaaccgcaaaugcagacacauuauguauagguuaucaugcgaacaauucaacagacacuguagacacaguacuggaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguucucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagucaguuaaaaaacaaugccaaggaaauuggaaacggcugcuuugaauuuuaccacaaaugcgauaacacaugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuggucauagcuguagaauauguauuuaa

SEQ ID NO: 36131 - RNA, 1695 nt, Artificial Sequence
  hemagglutinin__InfluenzaA__ADM14866
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucggacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcauaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuggucauagcuguagaauauguauuuaa

SEQ ID NO: 36132 - RNA, 1695 nt, Artificial Sequence
  hemagglutinin__InfluenzaA__ADM14876
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucaaacaaagguguaacggcagcauguccucaugcuggagcaaaaagcuucuacaaaaauuuaauauggcuaguuaaaaaaggaaauucauacccaaagcucagcaaauccuacauuaaugauaaagagaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuggucauagcuguagaauauguauuuaa

SEQ ID NO: 36133 - RNA, 1704 nt, Artificial Sequence
  hemagglutinin__InfluenzaA__ADM14885
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaauuacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagagaaagaaguccucgugcuauggggcauucaccauccaucuacuagugcugaccaacaaagucucuaucagaaugcagaugcauauguuuuuguggggacaucaagauacagcaagaaguucaagccggaaauaguaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcugaaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaaauuauaugaaaagguaagaagccaguuaaaaaacaaugccaaggaaauuggaaacggcugcuuugaauuuuaccacaaaugcgauaacacaugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuggucaugggucucuacaguguagaauauguauuuaa

SEQ ID NO: 36134 - RNA, 1695 nt, Artificial Sequence
  hemagglutinin__InfluenzaA__ADM14894
augaaggcaauacuaguaguucugcuauauacauuugcaaccgcaaaugcagacacauuauguauagguuaucaugcgaacaauucaacagacacuguggacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagagaaagaaguccucgugcuauggggcauucaccauccaucuacuagugcugaccaacaaagucucuaucagaaugcagaugcauauguuuuuguggggacaucaagauacagcaagaaguucaagccggaaauaguaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauugucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacgggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaaauuauaugaaaagguaagaagccaguuaaaaaacaaugccaaggaaauuggaaacggcugcuuugaauuuuaccacaaaugcgauaacacgugcaugaaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuggucauagcuguagaauauguauuuaa

SEQ ID NO: 36135 - RNA, 1695 nt, Artificial Sequence
  hemagglutinin__InfluenzaA__ADM14903
augaaggcaauacuaguaguucugcuauguacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaacccagagugugaaucacucuccacagcaagcucaugguccuacauuguggaaacaucuaguucagacaauggaacguguuacccaggagauuucaucgauuaugaggaguuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuggucauagcuguagaauauguauuuaa

SEQ ID NO: 36136 - RNA, 1695 nt, Artificial Sequence
  hemagglutinin__InfluenzaA__ADM14912
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcuauaagacccaaagugagagaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacgcagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuggucauagcuguagaauauguauuuaa

SEQ ID NO: 36137 - RNA, 1695 nt, Artificial Sequence
  hemagglutinin__InfluenzaA__ADM14921
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagaacaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugccgaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuggucauagcuguagaauauguauuuaa

SEQ ID NO: 36138 - RNA, 1701 nt, Artificial Sequence
  hemagglutinin__InfluenzaA__ADM14930
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaaugcaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcugggucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36139 - RNA, 1701 nt, Artificial Sequence
  hemagglutinin__InfluenzaA__ADM14948
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaggaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaggcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36140 - RNA, 1695 nt, Artificial Sequence
  hemagglutinin__InfluenzaA__ADM14966
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccuucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccacuuggaaaaaagaauagagaauuuaaauaaaaaaguugaugaugguuuccuagacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuggucauagcuguagaauauguauuuaa

SEQ ID NO: 36141 - RNA, 1701 nt, Artificial Sequence
  hemagglutinin__InfluenzaA__ADM14975
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccuucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuagacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36142 - RNA, 1701 nt, Artificial Sequence
  hemagglutinin__InfluenzaA__ADM14985
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucaaacaaagguguaacggcagcauguccucaugcuggagcaaaaagcuucuacaaaaauuuaauauggcuaguuaaaaaaggaaauucauacccaaagcucagcaaauccuacauuaaugauaaagagaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugaggggacaagaagggagaaugaacuauuacuggacacuaguagagccgggagacaaaauaacauucgaagcaacuggaaaucuagugguaccgagauaugcauucgcaauggaaagaaaugcuggaucugguauugucauuucagauacaccaguccacgauugcaauacaacuugucagacacccaagggugcuauaaacaccagccucccauuucagaauauacauucgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36143 - RNA, 1701 nt, Artificial Sequence
  hemagglutinin__InfluenzaA__ADM23841
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccaucaaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36144 - RNA, 1701 nt, Artificial Sequence; identical to SEQ ID NO: 34337
  hemagglutinin__InfluenzaA__ADM23843

SEQ ID NO: 36145 - RNA, 1701 nt, Artificial Sequence
  hemagglutinin__InfluenzaA__ADM23844
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuauuucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacgacagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccaucaaucuacuagugcugaccaacaaagucucuaucagaaugcagaugcauauguuuuuguggggacaucaagauacagcaagaaguucaagccggaaaucgcaauaagacccaaagugagggaucaagaagguagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36146 - RNA, 1701 nt, Artificial Sequence
  hemagglutinin__InfluenzaA__ADM23845
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuauuucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacgacagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccaucaaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugccauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36147 - RNA, 1701 nt, Artificial Sequence
  hemagglutinin__InfluenzaA__ADM23846
augaaggcaauacuaguaguucugcuauauacauuugcaaccgcaaaugcagacacauuauguauagguuaucaugcgaacaauucaacagacacuguagacacagugcuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuauuucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacgacagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36148 - RNA, 1701 nt, Artificial Sequence
  hemagglutinin__InfluenzaA__ADM23847
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuauuucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacgacagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccaucaaucuacuagugcugaccaacaaagucucuaucagaaugcagaugcauauguuuuuguggggacaucaagauacagcaagaaguucaagccggaaaucgcaauaagacccaaagugagggaucaagaagggagaaugaacuauuacuggacacuaguagagccgggagacaaaauaacauucgaagcaacuggaaaucuagugguaccgagauaugcauucgcaauggaaagaaauguuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36149 - RNA, 1701 nt, Artificial Sequence
  hemagglutinin__InfluenzaA__ADM23849
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccaucaaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36150 - RNA, 1701 nt, Artificial Sequence
  hemagglutinin__InfluenzaA__ADM23851
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaaugguacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccaucaaucuacuagugcugaccaacaaagucucuaucagaaugcagaugcauauguuuuuguggggucaucaagauacagcaagaaguucaagccggaaauagcaauaagacccaaagugagggaucaagaagguagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccuaaauauguaaaaagcacaaaauugagacuggccacaggauugaggaaugucccgucuauucaaucuagaggccuauuuggggccauugccgguuucauugaagggggguggacagggaugguagacggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagaaaauuuaaauaaaaaaguugaugaugguuuccuggacauuuggacuuacaaugccgaacuguuaguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36151 - RNA, 1701 nt, Artificial Sequence
  hemagglutinin__InfluenzaA__ADM23852
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaaugguacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagguagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccuaaauauguaaaaagcacaaaauugagacuggccacaggauugaggaaugucccgucuauucaaucuagaggccuauuuggggccauugccgguuucauugaagggggguggacagggaugguagacggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagaaaauuuaaauaaaaaaguugaugaugguuuccuggacauuuggacuuacaaugccgaacuguuaguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36152 - RNA, 1701 nt, Artificial Sequence
  hemagglutinin__InfluenzaA__ADM23853
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccuaaauauguaaaaagcacaaaauugagacuggccacaggauugaggaaugucccgucuauucaaucuagaggccuauuuggggccauugccgguuucauugaagggggguggacagggaugguagacggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagaaaauuuaaauaaaaaaguugaugaugguuuccuggacauuuggacuuacaaugccgaacuguuaguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36153 - RNA, 1701 nt, Artificial Sequence; identical to SEQ ID NO: 33457
  hemagglutinin__InfluenzaA__ADM23855

SEQ ID NO: 36154 - RNA, 1701 nt, Artificial Sequence
  hemagglutinin__InfluenzaA__ADM23856
augaaggcaauacuaguaguucugcuauauacauuugcaaccguaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagaaugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaaaggaaagaaguccucgugcuauggggcauucaccaucaaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacaaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36155 - RNA, 1701 nt, Artificial Sequence; identical to SEQ ID NO: 33922
  hemagglutinin__InfluenzaA__ADM25945

SEQ ID NO: 36156 - RNA, 1701 nt, Artificial Sequence
  hemagglutinin__InfluenzaA__ADM25948
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagaaugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgauuacaauuggaaaaugucccaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36157 - RNA, 1701 nt, Artificial Sequence
  hemagglutinin__InfluenzaA__ADM26264
augaaggcaauacuaguaguucugcuauauacauuuacaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauucgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauauucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36158 - RNA, 1701 nt, Artificial Sequence; identical to SEQ ID NO: 35202
  hemagglutinin__InfluenzaA__ADM26265

SEQ ID NO: 36159 - RNA, 1701 nt, Artificial Sequence
  hemagglutinin__InfluenzaA__ADM26266
augaaggcaauacuaguaguucugcuauauacauuuacaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucuauaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauucgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36160 - RNA, 1701 nt, Artificial Sequence
  hemagglutinin__InfluenzaA__ADM26267
augaaggcaauacuaguaguucugcuauauacauuuacaaccgcaaaugcagacacauuauguauagguuaucaugcgaacaauucaacagacacuguagauacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauucgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36161 - RNA, 1701 nt, Artificial Sequence
  hemagglutinin__InfluenzaA__ADM26268
augaaggcaauacuaguaguucugcuauauacauuuacaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauucgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaaaagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36162 - RNA, 1701 nt, Artificial Sequence
  hemagglutinin__InfluenzaA__ADM26269
augaagacaauacuaguaguucugcuauauacauuuacaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauucgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaaaagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36163 - RNA, 1701 nt, Artificial Sequence
  hemagglutinin__InfluenzaA__ADM26270
augaaggcaauacuaguaguucugcuauauacauuuacaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauaugucuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauucgaucacaauuggaagauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggaccaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36164 - RNA, 1701 nt, Artificial Sequence
  hemagglutinin__InfluenzaA__ADM26271
augaaggcaauacuaguaguucugcuauauacauuuacaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauucgaucacaauuggaaaauguccaaaauauguaaaaagcacaaaauugagacuggccacaggauugaggaaugucccaucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36165 - RNA, 1701 nt, Artificial Sequence
  hemagglutinin__InfluenzaA__ADM26272
augaaggcaauacuaguaguucugcuauauacauuuacaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauucgaucacaauuggaagauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36166 - RNA, 1701 nt, Artificial Sequence
  hemagglutinin__InfluenzaA__ADM26274
augaaggcaauacuaguaguucugcuauauacauuuacaaccgcaaaugcagacacauuauguauagguuaucaugcgaacaauucaacagacacuguagacacaguacuagaaaagaauguaacaguaacacacucuguuaaccuucuagaagacaagcauaaugggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggagauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauucgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaaggacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36167 - RNA, 1701 nt, Artificial Sequence; identical to SEQ ID NO: 35202
  hemagglutinin__InfluenzaA__ADM26276

SEQ ID NO: 36168 - RNA, 1701 nt, Artificial Sequence
  hemagglutinin__InfluenzaA__ADM26277
augaaggcaauacuaguaguucugcuauauacauuuacaaccgcaaaugcagacacauuauguauagguuaucaugcgaacaauucaacagacacuguagauacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauucgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuagacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugauagucucccugggggcaaucaguuucuggauguguucuaaugggucucuacaguguagaauauguauuuaa

SEQ ID NO: 36169 - RNA, 1701 nt, Artificial Sequence
  hemagglutinin__InfluenzaA__ADM26278
augaaggcaauacuaguaguucugcuauauacauuuacaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugaaauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuucuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauuugcauucgcaauggaaagaaaugcuggaucugguauuaucauuucagauacaccaguccacgauugcaauacaacuugucagacacccaagggugcuauaaacaccagccucccauuucagaauauacauucgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaaaagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36170 - RNA, 1701 nt, Artificial Sequence
  hemagglutinin__InfluenzaA__ADM26279
augaaggcaauacuaguaguucugcuauacacauuuacaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcaugcccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugaggggacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauucgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaagggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauauucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36171 - RNA, 1701 nt, Artificial Sequence
  hemagglutinin__InfluenzaA__ADM26280
augaaggcaauacuaguaguucugcuauauacauuuacaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauucgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgagcuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauauucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36172 - RNA, 1701 nt, Artificial Sequence
  hemagglutinin__InfluenzaA__ADM26281
augaaggcaauacuaguaguucugcuauauacauuugcaaccgcaaaugcagacacauuauguauagguuaucaugcgaacaauucaacagauacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaguauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugauaagauuacuaacaaaguaaauucuguuauugaaaagaugaauacacaguucacagcaguagguaaagaguucaaccaccuggaaagaagaauagagaauuuaaauaaaaagguugaugaugguuuccuggacauuuggacuuacaaugccgagcuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggguuuaccagauuuuggcgaucuauucaacugucgccaguucauugguacugguagucucccugggggcaaucaguuucuggaugugcucuaaugggucucuacaguguagaauauguauuuaa

SEQ ID NO: 36173 - RNA, 1701 nt, Artificial Sequence
  hemagglutinin__InfluenzaA__ADM26282
augaaggcaauacuaguaguucugcuauauacauuuacaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccaugauugcaauacaacuugucagacacccaagggugcuauaaacaccagccucccauuucagaauauacauucgaucacaauuggaaaauguccaaaauauguaaaaagcacaaaauugagacuggccacaggauugaggaaugucccguccauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaagaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36174 - RNA, 1701 nt, Artificial Sequence
  hemagglutinin__InfluenzaA__ADM26283
augaaggcaauacuaguaguucugcuauauacauuuacaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauucgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuauugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaagaauuuaccagauuuuggcgaucuauucaacugucgccaguucauugguacugguagucucccugggggcaaucaguuucuggaugugcucuaaugggucucuacaguguagaauauguauuuaa

SEQ ID NO: 36175 - RNA, 1701 nt, Artificial Sequence
  hemagglutinin__InfluenzaA__ADM26284
augaaggcaauacuaguaguucugcuauauacauuuacaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguaucaucauuucagauacaccaguccacgauugcaauacaacuugucagacacccaagggugcuauaaacaccagccucccauuucagaauauacauucgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgagcuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36176 - RNA, 1701 nt, Artificial Sequence
  hemagglutinin__InfluenzaA__ADM26285
augaaggcaauacuaguaguucugcuauauacauuuacaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcaugcccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauucgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaagggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaauagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36177 - RNA, 1701 nt, Artificial Sequence
  hemagglutinin__InfluenzaA__ADM26784
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcaugaggagaucuaauaacaguuucuuuaguagauugaauugguugacccacuuaaaauucaaauacccagcauuaaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 36178 - RNA, 1701 nt, Artificial Sequence; identical to SEQ ID NO: 35874
  hemagglutinin__InfluenzaA__ADM26795

SEQ ID NO: 36179 - RNA, 1701 nt, Artificial Sequence
  hemagglutinin__InfluenzaA__ADM26817
augaagacuaccauugcuuugagccacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucagcaggugaaauaugcgacaguccucaucagauccuugauggagaaaacugcacacuaauagaugcucuauugggagacccucagugugauggcuuccaaaauaagaaaugggaccuuuuuguugaacgaagaagagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaauggaaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 36180 - RNA, 1704 nt, Artificial Sequence
  hemagglutinin__InfluenzaA__ADM31424
auggagaaaauagugcuucuuuuuacaacaaucagccuuguuaaaagcgaucauauuugcauugguuaucaugcaaauaacucgacagagcagguugacacaauaauggaaaagaacguuacuguuacacaugcccaagacauacuggaaaagacacacaacgggaagcucugcgaucuaaauggagugaagccucugauuuuaaaagauuguaguguagcgggauggcuccucggaaacccauugugugacgaauucaucaaugugccagaauggucuuacauaguagagaaggccaauccagccaaugaccucuguuacccagggaauuucaacgauuaugaagaauugaaacaccuauugagcaggauaaaccauuuugagaaaauacagaucauccccaaagauucuuggucagaucaugaagccucauugggggugagcgcagcauguucauaccagggaaauuccuccuucuucagaaacgugguauggcuuaucaaaaaggacaaugcauacccaacaauaaagaaagacuacaauaauaccaaccaagaagaucucuugguacugugggggauucaccauccuaaugaugaggcagagcagacaaggcucuaucaaaacccaaccaccuauauuuccauugggacaucaacacuaaaccagagauugguaccaaaaauagccacuagauccaaaauaaacgggcaaaguggcaggauagauuucuucuggacaauuuuaaaaccgaaugaugcaauccacuucgagaguaauggaaauuucauugcuccagaauaugcauacaaaauugucaagaaaggagacuccacaauuaugaaaagugaaguggaauaugguaacugcaacaccaggugucagacuccgauaggggcgauaaacucuaguaugccauuccacaacauacacccucucaccaucggagaaugucccaaauaugugaaaucaaacaaauuaguccuugcgacugggcucagaaauaguccucaaagagagagaagaagaaaaagaggacuguuuggagcuauagcagguuuuauagagggaggauggcagggaaugguagaugguugguauggguaccaccacagcaaugagcaggggaguggguacgcugcagacaaagaaucuacucaaaaggcaauagacggagucaccaacaaggucaacucgaucauugacaaaaugaacacucaguuugaggccguaggaagggaauuuaauaacuuagagaggagaauagagaauuuaaacaagaaaauggaagacggauuccuagauguuuggacuuauaaugcugaacuucugguucucauggaaaaugagagaacucuagacuuccaugacucaaaugucaagaaccuuuacgauaaggucagacuacagcuuaaggauaaugcaaaagaguuggguaacgguuguuucgaguucuaucacaaauguaauaaugaauguauggaaaguguaagaaacggaacguaugacuacccgcaguauucagaagaagcaagauuaaaaagagaggaaauaaguggaguaaaauuggaaucaauaggaaucuaccaaauacugucaauuuauucaacaguggcgaguucccuagugcuggcaaucaugauggcuggucugucuuuauggauguguuccaacgggucguuacagugcagaauuugcauuuaa

SEQ ID NO: 36181 - RNA, 1701 nt, Artificial Sequence
  hemagglutinin__InfluenzaA__ADM31478
augaaggcaauacuaguaguucugcuauauacauuuguaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggaauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacuugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36182 - RNA, 1701 nt, Artificial Sequence
  hemagglutinin__InfluenzaA__ADM31488
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauuuggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaaaauacagcaagaaguucaagccggaaauagcaauuagacccaaagugagggaucaagaagggagaaugaacuauuacuggacacuaguagagccgggagacaaaauaacauucgaagcaacuggaaaucuagugguaccaagauaugcauucgcaauggaaagaaaugcuggaucugguauuaucauuucagauacaccaguccaugauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaguuggaaacggcugcuuugaauuuuaccacaaaugugauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuucuggaugugcucuaaugggucucuacaguguagaauauguauuuaa

SEQ ID NO: 36183 - RNA, 1701 nt, Artificial Sequence
  hemagglutinin__InfluenzaA__ADM31498
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguaaagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcagggaucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36184 - RNA, 1701 nt, Artificial Sequence
  hemagglutinin__InfluenzaA__ADM31508
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaggucauggcccaaucaugacucgaacaaagguguaacggcagcauguccucaugcuggagcaaaaagcuucuacaaaaguuuaauauggcuaguuaaaaaaggaaauucauacccaaagcucagcaaauccuacauuaaugauaaagggaaagaaguccucgugcuauggggaauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacgcuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36185 - RNA, 1701 nt, Artificial Sequence
  hemagglutinin__InfluenzaA__ADM31518
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacguuaaugauaaagggaaagaaguccuagugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36186 - RNA, 1701 nt, Artificial Sequence
  hemagglutinin__InfluenzaA__ADM31528
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacauguuacccaggagauuucaucgauuaugaggagcuaagagagcaauugagcucagugucaucauuugaaagguuugagauguuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccauccacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauacgcauucgcaauggaaagaaaugcuggaucugguauuaucauuucagauacaccaguucacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaguuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36187 - RNA, 1701 nt, Artificial Sequence
  hemagglutinin__InfluenzaA__ADM31538
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcaugacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugccauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36188 - RNA, 1701 nt, Artificial Sequence
  hemagglutinin__InfluenzaA__ADM31548
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggagguagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36189 - RNA, 1701 nt, Artificial Sequence
  hemagglutinin__InfluenzaA__ADM31558
augaaggcaauacuaguaguucugcuauauacguuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuagaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36190 - RNA, 1701 nt, Artificial Sequence
  hemagglutinin__InfluenzaA__ADM31568
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaauuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacaggaaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuaccccaaauacucagaggaagcaaaauuaaacagagaagaaauagaugggguaaagcuggaaucaacaaggauuuaccagauucuggcgaucuauucaacugucgccaguucauugguacugguagucucccugggggcaaucaguuucuggaugugcucuaaugggucucuacaguguagaauauguauuuaa

SEQ ID NO: 36191 - RNA, 1701 nt, Artificial Sequence
  hemagglutinin__InfluenzaA__ADM31578
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuauauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36192 - RNA, 1701 nt, Artificial Sequence
  hemagglutinin__InfluenzaA__ADM31588
augaaggcaauacuaguaguucugcuauauacauuugcaaccgcaaaugcagacacauuauguauagguuaucaugcgaacaauucaacagacacuguagacacaauacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacauguuacccaggagauuucaucgauuaugaggagcuaagagagcaauugagcucagugucaucauuugaaagguuugagauguuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucaacaaauccuacauuaaugauaaagggaaagaaguccucguacuauggggcauucaccauccauccacuagugcugaccaacaaagucucuaucagaaugcagaugcauauguuuuuguggggacaucaagauacagcaagaaguucaagacggaaauagcaauaagacccaaagugagggaucaagaagggagaaugaacuauuacuggacacuaguagagccgggagacaaaauaacauucgaagcaacuggaaaucuagugguaccgagauacgcauucgcaauggaaagaaaugcuggaucugguauuaucauuucagauacaccaguucacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaguuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36193 - RNA, 1701 nt, Artificial Sequence
  hemagglutinin__InfluenzaA__ADM31598
augaaugcaauacuaguaguucugcuauauacauuugcaaccgcaaaugcagacacauuauguauagguuaucaugcgaacaauucaacagacacuguagacacauuacuagaaaagaauguaacaguaacacacucuguuaaccuucuagaagacaagcauaacgggaaacuaugcaaacuaagagggguagccccauugcauuuggguaaaugugacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccgaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccagaaauagcaauaagacccaaagugagggaucaagaagggagaaugaacuaucacuggacacuaguagagccgggagacaaaauaacauucgaagcaacuggaaaucuagugguaccgagauaugcauucgcaauggaaagaaaugcuggaucugguauuaucauuucagaugcaccaguccacgauugcaauacaacuugucaaacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaauaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36194 - RNA, 1701 nt, Artificial Sequence
  hemagglutinin__InfluenzaA__ADM31608
augaaggcaauacuaguaguucugcuauauacauuugcaaccguaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauacgcauucgcaauggaaagaaaugcuggaucugguauuaucauuucagauacaccaguccaugauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36195 - RNA, 1701 nt, Artificial Sequence
  hemagglutinin__InfluenzaA__ADM31618
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggaucuaccagauuuuggcgaucuauucaacugucgccaguucauugguacugguagucucccugggggcaaucaguuucuggaugugcucuaaugggucucuacaguguagaauauguauuuaa

SEQ ID NO: 36196 - RNA, 1701 nt, Artificial Sequence; identical to SEQ ID NO: 35343
  hemagglutinin__InfluenzaA__ADM31628

SEQ ID NO: 36197 - RNA, 1701 nt, Artificial Sequence; identical to SEQ ID NO: 36076
  hemagglutinin__InfluenzaA__ADM31638

SEQ ID NO: 36198 - RNA, 1701 nt, Artificial Sequence; identical to SEQ ID NO: 35986
  hemagglutinin__InfluenzaA__ADM31648

SEQ ID NO: 36199 - RNA, 1701 nt, Artificial Sequence; identical to SEQ ID NO: 35340
  hemagglutinin__InfluenzaA__ADM31658

SEQ ID NO: 36200 - RNA, 1701 nt, Artificial Sequence; identical to SEQ ID NO: 35786
  hemagglutinin__InfluenzaA__ADM31668

SEQ ID NO: 36201 - RNA, 1701 nt, Artificial Sequence
  hemagglutinin__InfluenzaA__ADM31688
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcgauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaauuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36202 - RNA, 1701 nt, Artificial Sequence
  hemagglutinin__InfluenzaA__ADM31698
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaaugcaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuauuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugauacugguagucucccugggggcaaucaguuucuggaugugcucuaaugggucucuacaguguagaauauguauuuaa

SEQ ID NO: 36203 - RNA, 1701 nt, Artificial Sequence; identical to SEQ ID NO: 36078
  hemagglutinin__InfluenzaA__ADM31708

SEQ ID NO: 36204 - RNA, 1701 nt, Artificial Sequence
  hemagglutinin__InfluenzaA__ADM31718
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacgaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36205 - RNA, 1701 nt, Artificial Sequence
  hemagglutinin__InfluenzaA__ADM31728
augaaggcaauacuaauaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucaggcaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaacucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucacuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36206 - RNA, 1701 nt, Artificial Sequence
  hemagglutinin__InfluenzaA__ADM31738
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcugguuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaagaagcuucuacaaaaauuuaauauggcuaguuaaaaaaggaaauucauacccaaagcucagcaaauccuacauuaaugauaaagggaaagaaguccucgugcuauggggcauucaccacccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaucacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuaccccaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36207 - RNA, 1701 nt, Artificial Sequence
  hemagglutinin__InfluenzaA__ADM31748
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaaugcaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuauuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucgacugucgccaguucauugguacugguagucucccugggggcaaucaguuucuggaugugcucuaaugggucucuacaguguagaauauguauuuaa

SEQ ID NO: 36208 - RNA, 1701 nt, Artificial Sequence
  hemagglutinin__InfluenzaA__ADM31758
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggauagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaauagauccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagaauggccacaggauugaggaaugucccgucuauucagucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaucaccuggaaaaaagaauagagaauuuaaauaaaaaaguugaugaugguuuccuggacauuuggacuuauaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36209 - RNA, 1701 nt, Artificial Sequence
  hemagglutinin__InfluenzaA__ADM31768
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaauagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaauuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36210 - RNA, 1701 nt, Artificial Sequence; identical to SEQ ID NO: 35362
  hemagglutinin__InfluenzaA__ADM31778

SEQ ID NO: 36211 - RNA, 1701 nt, Artificial Sequence; identical to SEQ ID NO: 35340
  hemagglutinin__InfluenzaA__ADM31798

SEQ ID NO: 36212 - RNA, 1701 nt, Artificial Sequence
  hemagglutinin__InfluenzaA__ADM31808
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucaggcaauggaacguguuacccaggagauuucaucgauuaugaggagcuaagagagcaauugagcucagugucaucauuugaaagguuugagauauuccccaaaacaaguucauggcccaaucaugacucgaacaaagguguaacggcagcauguccucaugcuggagcaaaaagcuucuacaaaaauuuauuauggcuaguuaaaaaaggaaacucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagggccgggagacaaaauaacauucgaagcaacuggaaaucuagugguaccgagauaugcauucgcaauggaaagaaaugcuggaucugguauuaucauuucagauacaccgguccacgauugcaauacaacuugucagacacccaagggugcuauaaacaccagccucccauuucagaauauacauccgaucacaauuggaaaauguccaaaauauguaaaaaguacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36213 - RNA, 1701 nt, Artificial Sequence; identical to SEQ ID NO: 35792
  hemagglutinin__InfluenzaA__ADM31818

SEQ ID NO: 36214 - RNA, 1701 nt, Artificial Sequence
  hemagglutinin__InfluenzaA__ADM31828
augaaggcaauacuaguaguucugcuauauacauuugcaaccgcaaaugcagacacauuauguauagguuaucaugcgaacaauucaacagacacuguagacacaguacuagaaaggaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaaaucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacauuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaaaguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacuguuagucucccugggggcaaucaguuucuggaugugcucuaaugggucucuacaguguagaauauguauuuaa

SEQ ID NO: 36215 - RNA, 1701 nt, Artificial Sequence; identical to SEQ ID NO: 36214
  hemagglutinin__InfluenzaA__ADM31838

SEQ ID NO: 36216 - RNA, 1701 nt, Artificial Sequence; identical to SEQ ID NO: 35362
  hemagglutinin__InfluenzaA__ADM31848

SEQ ID NO: 36217 - RNA, 1701 nt, Artificial Sequence
  hemagglutinin__InfluenzaA__ADM31858
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguucucaugcuggagcaaaaagcuucuacaaaaauuuaauauggcuaguuaaaaaaggaaauucauacccaaagcucaacaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccaucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauacgaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguagagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36218 - RNA, 1701 nt, Artificial Sequence
  hemagglutinin__InfluenzaA__ADM31868
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaauuacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcguucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuaguggugccgagauaugcauucucaauggaaagaaaugcuggaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36219 - RNA, 1701 nt, Artificial Sequence
  hemagglutinin__InfluenzaA__ADM31878
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaaggcaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaucaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucaaacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacguguauggaaagugucaaaaaugggacuuaugacuaccccaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36220 - RNA, 1701 nt, Artificial Sequence
  hemagglutinin__InfluenzaA__ADM31888
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaagguugaugaugguuucuuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36221 - RNA, 1701 nt, Artificial Sequence; identical to SEQ ID NO: 35992
  hemagglutinin__InfluenzaA__ADM31898

SEQ ID NO: 36222 - RNA, 1701 nt, Artificial Sequence
  hemagglutinin__InfluenzaA__ADM31908
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgaucaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36223 - RNA, 1701 nt, Artificial Sequence; identical to SEQ ID NO: 34934
  hemagglutinin__InfluenzaA__ADM31918

SEQ ID NO: 36224 - RNA, 1701 nt, Artificial Sequence; identical to SEQ ID NO: 34945
  hemagglutinin__InfluenzaA__ADM31928

SEQ ID NO: 36225 - RNA, 1701 nt, Artificial Sequence; identical to SEQ ID NO: 34945
  hemagglutinin__InfluenzaA__ADM31948

SEQ ID NO: 36226 - RNA, 1701 nt, Artificial Sequence; identical to SEQ ID NO: 33173
  hemagglutinin__InfluenzaA__ADM31958

SEQ ID NO: 36227 - RNA, 1701 nt, Artificial Sequence
  hemagglutinin__InfluenzaA__ADM31968
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuggaagacaagcauaacgggaaacuaugcaaacuaaaagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaaaauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacacuagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaagggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36228 - RNA, 1701 nt, Artificial Sequence
  hemagglutinin__InfluenzaA__ADM31978
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcacaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguucucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36229 - RNA, 1701 nt, Artificial Sequence
  hemagglutinin__InfluenzaA__ADM31998
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauucauccgaucacaauuggaaaauguccaaaauauguaaaaagcacaaaauugagacuggccacaggauugaggaaugucccgucuauucaauccagaggccuauuuggggccauugccgguuucauugaagggggguggacagggaugguagaugggugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggauauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36230 - RNA, 1701 nt, Artificial Sequence; identical to SEQ ID NO: 33826
  hemagglutinin__InfluenzaA__ADM32008

SEQ ID NO: 36231 - RNA, 1701 nt, Artificial Sequence
  hemagglutinin__InfluenzaA__ADM32018
augaaggcaauacuaguaguucugcuauauacauuugcaaucgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaaugugacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36232 - RNA, 1701 nt, Artificial Sequence
  hemagglutinin__InfluenzaA__ADM32028
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguugaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauguacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36233 - RNA, 1701 nt, Artificial Sequence
  hemagglutinin__InfluenzaA__ADM32038
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaaaagggguagccccauugcauuuggguaaauguaacauugcuggcuggauccugggaaauccagagugugaaucacucuccacagcaagcucaugguccuacauuguggaaacaucuaguucagacaaugggacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaaaauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36234 - RNA, 1701 nt, Artificial Sequence; identical to SEQ ID NO: 33390
  hemagglutinin__InfluenzaA__ADM32048

SEQ ID NO: 36235 - RNA, 1701 nt, Artificial Sequence; identical to SEQ ID NO: 34951
  hemagglutinin__InfluenzaA__ADM32058

SEQ ID NO: 36236 - RNA, 1701 nt, Artificial Sequence; identical to SEQ ID NO: 34951
  hemagglutinin__InfluenzaA__ADM32068

SEQ ID NO: 36237 - RNA, 1701 nt, Artificial Sequence; identical to SEQ ID NO: 33173
  hemagglutinin__InfluenzaA__ADM32078

SEQ ID NO: 36238 - RNA, 1701 nt, Artificial Sequence
  hemagglutinin__InfluenzaA__ADM32088
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguucucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagucucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36239 - RNA, 1701 nt, Artificial Sequence
  hemagglutinin__InfluenzaA__ADM32098
augaaggcaauacuaguaguucugcuauauacauuugcaaucgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36240 - RNA, 1701 nt, Artificial Sequence; identical to SEQ ID NO: 33173
  hemagglutinin__InfluenzaA__ADM32108

SEQ ID NO: 36241 - RNA, 1701 nt, Artificial Sequence
  hemagglutinin__InfluenzaA__ADM32551
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaaaagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaaaauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaauguagaauauguauuuaa

SEQ ID NO: 36242 - RNA, 1701 nt, Artificial Sequence; identical to SEQ ID NO: 36229
  hemagglutinin__InfluenzaA__ADM32561

SEQ ID NO: 36243 - RNA, 1701 nt, Artificial Sequence; identical to SEQ ID NO: 33390
  hemagglutinin__InfluenzaA__ADM32571

SEQ ID NO: 36244 - RNA, 1701 nt, Artificial Sequence
  hemagglutinin__InfluenzaA__ADM32581
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaaaccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36245 - RNA, 1701 nt, Artificial Sequence; identical to SEQ ID NO: 34945
  hemagglutinin__InfluenzaA__ADM32591

SEQ ID NO: 36246 - RNA, 1701 nt, Artificial Sequence; identical to SEQ ID NO: 33173
  hemagglutinin__InfluenzaA__ADM32601

SEQ ID NO: 36247 - RNA, 1701 nt, Artificial Sequence; identical to SEQ ID NO: 33173
  hemagglutinin__InfluenzaA__ADM32611

SEQ ID NO: 36248 - RNA, 1701 nt, Artificial Sequence
  hemagglutinin__InfluenzaA__ADM32621
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccaucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacaucuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36249 - RNA, 1701 nt, Artificial Sequence
  hemagglutinin__InfluenzaA__ADM32631
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaaaagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauuuauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaaaauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacaauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguuuaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36250 - RNA, 1701 nt, Artificial Sequence; identical to SEQ ID NO: 34951
  hemagglutinin__InfluenzaA__ADM32641

SEQ ID NO: 36251 - RNA, 1701 nt, Artificial Sequence
  hemagglutinin__InfluenzaA__ADM32651
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggcuuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36252 - RNA, 1701 nt, Artificial Sequence
  hemagglutinin__InfluenzaA__ADM32661
augaaggcaauacuaguaguucugcuauauacauuugcaaucgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaacgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36253 - RNA, 1701 nt, Artificial Sequence; identical to SEQ ID NO: 34761
  hemagglutinin__InfluenzaA__ADM32671

SEQ ID NO: 36254 - RNA, 1701 nt, Artificial Sequence; identical to SEQ ID NO: 33173
  hemagglutinin__InfluenzaA__ADM32681

SEQ ID NO: 36255 - RNA, 1701 nt, Artificial Sequence; identical to SEQ ID NO: 35992
  hemagglutinin__InfluenzaA__ADM32691

SEQ ID NO: 36256 - RNA, 1701 nt, Artificial Sequence; identical to SEQ ID NO: 33771
  hemagglutinin__InfluenzaA__ADM32701

SEQ ID NO: 36257 - RNA, 1701 nt, Artificial Sequence; identical to SEQ ID NO: 34982
  hemagglutinin__InfluenzaA__ADM32711

SEQ ID NO: 36258 - RNA, 1701 nt, Artificial Sequence; identical to SEQ ID NO: 34982
  hemagglutinin__InfluenzaA__ADM32721

SEQ ID NO: 36259 - RNA, 1701 nt, Artificial Sequence; identical to SEQ ID NO: 34934
  hemagglutinin__InfluenzaA__ADM32741

SEQ ID NO: 36260 - RNA, 1701 nt, Artificial Sequence; identical to SEQ ID NO: 34982
  hemagglutinin__InfluenzaA__ADM32751

SEQ ID NO: 36261 - RNA, 1701 nt, Artificial Sequence; identical to SEQ ID NO: 34761
  hemagglutinin__InfluenzaA__ADM32761

SEQ ID NO: 36262 - RNA, 1701 nt, Artificial Sequence
  hemagglutinin__InfluenzaA__ADM32771
augaaggcaauacuaguaguucugcuauauacauuugcaaccgcaaaugcagacacauuauguauagguuaucaugcaaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcgaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuaaaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36263 - RNA, 1701 nt, Artificial Sequence
  hemagglutinin__InfluenzaA__ADM32781
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguugaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaaaaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagcuucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36264 - RNA, 1701 nt, Artificial Sequence; identical to SEQ ID NO: 33390
  hemagglutinin__InfluenzaA__ADM32791

SEQ ID NO: 36265 - RNA, 1701 nt, Artificial Sequence
  hemagglutinin__InfluenzaA__ADM32801
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaaaacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguaucaucauuucagauacaccaguccacgauugcaauacaacuugucagacacccaagggugcuauaaauaccagccucccauuucagaauauacauccgaucacaauuggaaaauguccaaaauauguaaaaagcacaaaauugagacuggccacaggauugaggaaugucccgucuauucaaucuagaggccuauuuggggcaauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuugaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36266 - RNA, 1701 nt, Artificial Sequence
  hemagglutinin__InfluenzaA__ADM32811
augaaggcaauacuaguaguucugcuauauacauuugcaaccgcaaaugcggacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggcuuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaaguguaaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36267 - RNA, 1701 nt, Artificial Sequence
  hemagglutinin__InfluenzaA__ADM32821
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacaucuggacuuacaaugccgaacuguugguucuauuggaaaaugaaagaacuuuggacuaccacgauucaaauguaaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucccuacaguguagaauauguauuuaa

SEQ ID NO: 36268 - RNA, 1701 nt, Artificial Sequence; identical to SEQ ID NO: 34761
  hemagglutinin__InfluenzaA__ADM32831

SEQ ID NO: 36269 - RNA, 1701 nt, Artificial Sequence; identical to SEQ ID NO: 36229
  hemagglutinin__InfluenzaA__ADM32841

SEQ ID NO: 36270 - RNA, 1701 nt, Artificial Sequence; identical to SEQ ID NO: 34761
  hemagglutinin__InfluenzaA__ADM32851

SEQ ID NO: 36271 - RNA, 1701 nt, Artificial Sequence; identical to SEQ ID NO: 33826
  hemagglutinin__InfluenzaA__ADM32861

SEQ ID NO: 36272 - RNA, 1701 nt, Artificial Sequence
  hemagglutinin__InfluenzaA__ADM32871
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccaagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuaccaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36273 - RNA, 1701 nt, Artificial Sequence; identical to SEQ ID NO: 35340
  hemagglutinin__InfluenzaA__ADM32881

SEQ ID NO: 36274 - RNA, 1701 nt, Artificial Sequence
  hemagglutinin__InfluenzaA__ADM32929
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacgcuguagaauauguauuuaa

SEQ ID NO: 36275 - RNA, 1701 nt, Artificial Sequence
  hemagglutinin__InfluenzaA__ADM32939
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaauuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaacugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacgcuguagaauauguauuuaa

SEQ ID NO: 36276 - RNA, 1701 nt, Artificial Sequence
  hemagglutinin__InfluenzaA__ADM32949
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucuuuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccgguccacgauugcaauacaacuugucagacacccaauggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaacgagcaggggucaggauaugcagccgaccugaagagcacacagaaugccauugacgagaucacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacgcuguagaauauguauuuaa

SEQ ID NO: 36277 - RNA, 1701 nt, Artificial Sequence
  hemagglutinin__InfluenzaA__ADM32958
augaaggcaauacuaguauuucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauuuggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggagucaucaagauacagcaagaaguucaagccggaaauagcaauuagacccaaagugagggaucaagaagggagaaugaacuauuacuggacacuaguagagccgggagacaaaauaacauucgaagcaacuggaaaucuagugguaccaagauaugcauucgcaauggaaagaaaugcuggaucugguauuaucauuucagauacaccaguccaugauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagacuagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaguuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuucuggaugugcucuaaugggucucuacgcuguagaauauguauuuaa

SEQ ID NO: 36278 - RNA, 1701 nt, Artificial Sequence
  hemagglutinin__InfluenzaA__ADM32977
augaaggcaauacuaguaguucugcuauguacauuugcaaccgcaaaugcagacacauuauguauagguuaucaugcgaacaauucaacagacacuguagacacaguacuagaaaagaaugucacagugacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgggauuacuaacaaaauaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacgcuguagaauauguauuuaa

SEQ ID NO: 36279 - RNA, 1701 nt, Artificial Sequence
  hemagglutinin__InfluenzaA__ADM32986
augaaggcaauacuaguaguucugcuauauacauuugcaaccgcaaaugcagacacauuauguauagguuaucaugcgaacaauucaacagacacuguagacacaguacuagaaaagaaugucacagugacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaauucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgggauuacuaacaaaauaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuugaacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacgcuguagaauauguauuuaa

SEQ ID NO: 36280 - RNA, 1701 nt, Artificial Sequence
  hemagglutinin__InfluenzaA__ADM32995
augaaggcaauacuaguaguucugcuauauacauuugcaaccgcaaaugcagacacauuauguauagguuaucaugcgaacaauucaacagacacuguagacacaguacuagaaaagaaugucacagugacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaauucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaaaauacaguaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacgggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgggauuacuaacaaaauaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacgcuguagaauauguauuuaa

SEQ ID NO: 36281 - RNA, 1701 nt, Artificial Sequence; identical to SEQ ID NO: 34281
  hemagglutinin__InfluenzaA__ADM33004

SEQ ID NO: 36282 - RNA, 1701 nt, Artificial Sequence
  hemagglutinin__InfluenzaA__ADM33023
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucaaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguaucaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36283 - RNA, 1701 nt, Artificial Sequence
  hemagglutinin__InfluenzaA__ADM33040
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacgcuguagaauauguauuuaa

SEQ ID NO: 36284 - RNA, 1701 nt, Artificial Sequence
  hemagglutinin__InfluenzaA__ADM33050
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucaacaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaguguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagaucacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaucacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacgcuguagaauauguauuuaa

SEQ ID NO: 36285 - RNA, 1701 nt, Artificial Sequence
  hemagglutinin__InfluenzaA__ADM33069
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcuauaagacccaaagugagagaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacgcagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacgcuguagaauauguauuuaa

SEQ ID NO: 36286 - RNA, 1701 nt, Artificial Sequence
  hemagglutinin__InfluenzaA__ADM33079
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagaacaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgauuacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacgcuguagaauauguauuuaa

SEQ ID NO: 36287 - RNA, 1701 nt, Artificial Sequence
  hemagglutinin__InfluenzaA__ADM33099
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcuaagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaaccuucgaagcaacuggaaaucuaaugguaccgagauaugcauucgcaauggaaagaaaugcuggaucugguauuaucauuucagauacaccaguccacgauugcaauacaacuugucagacacccaagggugcuauaaacacuagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacgcuguagaauauguauuuaa

SEQ ID NO: 36288 - RNA, 1701 nt, Artificial Sequence; identical to SEQ ID NO: 36287
  hemagglutinin__InfluenzaA__ADM33109

SEQ ID NO: 36289 - RNA, 1701 nt, Artificial Sequence
  hemagglutinin__InfluenzaA__ADM33128
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacuuuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggaucuaccagauuuuggcgaucuauucaacugucgccaguucauugguacugguagucucccugggggcaaucaguuucuggaugugcucuaaugggucucuacgcuguagaauauguauuuaa

SEQ ID NO: 36290 - RNA, 1701 nt, Artificial Sequence; identical to SEQ ID NO: 36289
  hemagglutinin__InfluenzaA__ADM33137

SEQ ID NO: 36291 - RNA, 1701 nt, Artificial Sequence; identical to SEQ ID NO: 36289
  hemagglutinin__InfluenzaA__ADM33147

SEQ ID NO: 36292 - RNA, 1701 nt, Artificial Sequence; identical to SEQ ID NO: 36289
  hemagglutinin__InfluenzaA__ADM33157

SEQ ID NO: 36293 - RNA, 1701 nt, Artificial Sequence
  hemagglutinin__InfluenzaA__ADM33167
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacguucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuaccccaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacgcuguagaauauguauuuaa

SEQ ID NO: 36294 - RNA, 1701 nt, Artificial Sequence
  hemagglutinin__InfluenzaA__ADM33177
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacguucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuaccccaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacagugcagaauauguauuuaa

SEQ ID NO: 36295 - RNA, 1701 nt, Artificial Sequence; identical to SEQ ID NO: 36289
  hemagglutinin__InfluenzaA__ADM33186

SEQ ID NO: 36296 - RNA, 1701 nt, Artificial Sequence; identical to SEQ ID NO: 36289
  hemagglutinin__InfluenzaA__ADM33195

SEQ ID NO: 36297 - RNA, 1701 nt, Artificial Sequence
  hemagglutinin__InfluenzaA__ADM33204
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacgcuguagaauaugcauuuaa

SEQ ID NO: 36298 - RNA, 1701 nt, Artificial Sequence
  hemagglutinin__InfluenzaA__ADM33222
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacgcuguagaauauguauuuaa

SEQ ID NO: 36299 - RNA, 1701 nt, Artificial Sequence
  hemagglutinin__InfluenzaA__ADM33232
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagacgaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36300 - RNA, 1701 nt, Artificial Sequence
  hemagglutinin__InfluenzaA__ADM33241
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaaugcaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaagaaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauaacaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacgcuguagaauauguauuuaa

SEQ ID NO: 36301 - RNA, 1701 nt, Artificial Sequence; identical to SEQ ID NO: 36298
  hemagglutinin__InfluenzaA__ADM33251

SEQ ID NO: 36302 - RNA, 1701 nt, Artificial Sequence
  hemagglutinin__InfluenzaA__ADM33260
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaaugcaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggagauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaauaccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacgcuguagaauauguauuuaa

SEQ ID NO: 36303 - RNA, 1701 nt, Artificial Sequence
  hemagglutinin__InfluenzaA__ADM33280
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacaguaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuucguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaggggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgauuuauucaacugucgccaguucauugguacugguagucucccugggggcaaucaguuucuggaugugcucuaaugggucucuacaguguagaauauguauuuaa

SEQ ID NO: 36304 - RNA, 1701 nt, Artificial Sequence
  hemagglutinin__InfluenzaA__ADM33290
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaagagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauucgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36305 - RNA, 1701 nt, Artificial Sequence; identical to SEQ ID NO: 33173
  hemagglutinin__InfluenzaA__ADM33300

SEQ ID NO: 36306 - RNA, 1701 nt, Artificial Sequence
  hemagglutinin__InfluenzaA__ADM33310
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucgagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36307 - RNA, 1701 nt, Artificial Sequence
  hemagglutinin__InfluenzaA__ADM33320
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacauuuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36308 - RNA, 1701 nt, Artificial Sequence; identical to SEQ ID NO: 33414
  hemagglutinin__InfluenzaA__ADM33340

SEQ ID NO: 36309 - RNA, 1701 nt, Artificial Sequence
  hemagglutinin__InfluenzaA__ADM33355
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacaauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36310 - RNA, 1701 nt, Artificial Sequence; identical to SEQ ID NO: 36309
  hemagglutinin__InfluenzaA__ADM33365

SEQ ID NO: 36311 - RNA, 1701 nt, Artificial Sequence; identical to SEQ ID NO: 33239
  hemagglutinin__InfluenzaA__ADM33375

SEQ ID NO: 36312 - RNA, 1701 nt, Artificial Sequence
  hemagglutinin__InfluenzaA__ADM33385
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacauccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36313 - RNA, 1701 nt, Artificial Sequence; identical to SEQ ID NO: 33620
  hemagglutinin__InfluenzaA__ADM33395

SEQ ID NO: 36314 - RNA, 1701 nt, Artificial Sequence; identical to SEQ ID NO: 33620
  hemagglutinin__InfluenzaA__ADM33405

SEQ ID NO: 36315 - RNA, 1701 nt, Artificial Sequence; identical to SEQ ID NO: 36309
  hemagglutinin__InfluenzaA__ADM33415

SEQ ID NO: 36316 - RNA, 1701 nt, Artificial Sequence
  hemagglutinin__InfluenzaA__ADM33425
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36317 - RNA, 1701 nt, Artificial Sequence
  hemagglutinin__InfluenzaA__ADM34007
augaaggcaauacuaguaguucugcuauauacauuugcaaccgcaaaugcagacacauuauguauagguuaucaugcgaacaauucaacagacacuguagacacgguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagagguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuagaagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugaugagauuaccaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugcugaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggauguguucuaaugggucucuacaguguagaauauguauuuaa

SEQ ID NO: 36318 - RNA, 1701 nt, Artificial Sequence; identical to SEQ ID NO: 33173
  hemagglutinin__InfluenzaA__ADM52443

SEQ ID NO: 36319 - RNA, 1701 nt, Artificial Sequence
  hemagglutinin__InfluenzaA__ADM52453
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugccggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaauccacgauugcaauacaacuugucagacacccaagggugcuauaaacaccagccucccauuucagaauguacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuauccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36320 - RNA, 1701 nt, Artificial Sequence
  hemagglutinin__InfluenzaA__ADM52473
augaaggcaauacuagcaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucaggcaauggaacguguuacccaggagauuucaucgauuaugaggagcuaagagagcaauugagcucagugucaucauuugaaagguuugagauauuccccaaaacaaguucauggcccaaucaugacucgaacaaagguguaacggcagcauguccucaugcuggagcaaaaagcuucuacaaaaauuuauuauggcuaguuaaaaaaggaaacucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagggccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaaguacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36321 - RNA, 1701 nt, Artificial Sequence; identical to SEQ ID NO: 34951
  hemagglutinin__InfluenzaA__ADM52483

SEQ ID NO: 36322 - RNA, 1701 nt, Artificial Sequence; identical to SEQ ID NO: 36229
  hemagglutinin__InfluenzaA__ADM52493

SEQ ID NO: 36323 - RNA, 1701 nt, Artificial Sequence; identical to SEQ ID NO: 33826
  hemagglutinin__InfluenzaA__ADM52513

SEQ ID NO: 36324 - RNA, 1701 nt, Artificial Sequence; identical to SEQ ID NO: 35992
  hemagglutinin__InfluenzaA__ADM52524

SEQ ID NO: 36325 - RNA, 1701 nt, Artificial Sequence; identical to SEQ ID NO: 34934
  hemagglutinin__InfluenzaA__ADM52534

SEQ ID NO: 36326 - RNA, 1701 nt, Artificial Sequence
  hemagglutinin__InfluenzaA__ADM52554
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36327 - RNA, 1701 nt, Artificial Sequence; identical to SEQ ID NO: 33826
  hemagglutinin__InfluenzaA__ADM52564

SEQ ID NO: 36328 - RNA, 1701 nt, Artificial Sequence
  hemagglutinin__InfluenzaA__ADM52574
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauccaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36329 - RNA, 1701 nt, Artificial Sequence
  hemagglutinin__InfluenzaA__ADM52584
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagaaccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36330 - RNA, 1701 nt, Artificial Sequence
  hemagglutinin__InfluenzaA__ADM52594
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauuguaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacaucuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36331 - RNA, 1701 nt, Artificial Sequence; identical to SEQ ID NO: 36326
  hemagglutinin__InfluenzaA__ADM52604

SEQ ID NO: 36332 - RNA, 1701 nt, Artificial Sequence; identical to SEQ ID NO: 33826
  hemagglutinin__InfluenzaA__ADM52614

SEQ ID NO: 36333 - RNA, 1701 nt, Artificial Sequence; identical to SEQ ID NO: 34945
  hemagglutinin__InfluenzaA__ADM52624

SEQ ID NO: 36334 - RNA, 1701 nt, Artificial Sequence; identical to SEQ ID NO: 34934
  hemagglutinin__InfluenzaA__ADM52634

SEQ ID NO: 36335 - RNA, 1701 nt, Artificial Sequence; identical to SEQ ID NO: 34936
  hemagglutinin__InfluenzaA__ADM52644

SEQ ID NO: 36336 - RNA, 1701 nt, Artificial Sequence; identical to SEQ ID NO: 33826
  hemagglutinin__InfluenzaA__ADM52654

SEQ ID NO: 36337 - RNA, 1701 nt, Artificial Sequence
  hemagglutinin__InfluenzaA__ADM52664
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguucucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaauaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36338 - RNA, 1701 nt, Artificial Sequence
  hemagglutinin__InfluenzaA__ADM52674
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaaaagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaaaauacagcaagaaguucaagccggaaauagcuauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36339 - RNA, 1701 nt, Artificial Sequence; identical to SEQ ID NO: 35992
  hemagglutinin__InfluenzaA__ADM52684

SEQ ID NO: 36340 - RNA, 1701 nt, Artificial Sequence; identical to SEQ ID NO: 34945
  hemagglutinin__InfluenzaA__ADM52704

SEQ ID NO: 36341 - RNA, 1701 nt, Artificial Sequence
  hemagglutinin__InfluenzaA__ADM52714
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguucucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaaaggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36342 - RNA, 1701 nt, Artificial Sequence
  hemagglutinin__InfluenzaA__ADM86399
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauuuggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauuagacccaaagugagggaucaagaagggagaaugaacuauuacuggacacuaguagagccgggagacaaaauaacauucgaagcaacuggaaaucuagugguaccaagauaugcauucgcaauggaaagaaaugcuggaucugguauuaucauuucagauacaccaguccaugauugcaauacaacuugucagacacccaagggugcuguaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugcugaacuguugguucuauuggaaaaugaaagaacuuuggacuaccacgauucaaaugugaagaacuuauaugaaaagguaagaagccagcuaaaaaacaaugccaaggaaguuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuucuggaugugcucuaaugggucucuacaguguagaauauguauuuaa

SEQ ID NO: 36343 - RNA, 1701 nt, Artificial Sequence
  hemagglutinin__InfluenzaA__ADM86409
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuagucaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36344 - RNA, 1701 nt, Artificial Sequence; identical to SEQ ID NO: 36343
  hemagglutinin__InfluenzaA__ADM86419

SEQ ID NO: 36345 - RNA, 1701 nt, Artificial Sequence; identical to SEQ ID NO: 36053
  hemagglutinin__InfluenzaA__ADM86440

SEQ ID NO: 36346 - RNA, 1701 nt, Artificial Sequence
  hemagglutinin__InfluenzaA__ADM86450
augaaggcaauacuaguaguucugcuauauacauuugcaaccgcaaaugcagacacauuauguauagguuaucaugcgaacaauucaacagacacuguagacacagugcuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuaccccaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36347 - RNA, 1707 nt, Artificial Sequence
  hemagglutinin__InfluenzaA__ADM95450
auggagaaaauagugcuucuuuuugcgauagucagucuuguuaaaagugaucagauuugcauugguuaccaugcaaacaacucgacagagcagguugacacaauaauggaaaagaacguuacuguuacacaugcccaagacauacuggaaaagacacauaacgggaagcucugugaucuagauggagugaagccucuaaucuugagagauuguaguguagcuggauggcuccucggaaacccaaugugugacgaauucaucaaugugccggaauggucuuauauaguggagaaggccaauccagucaaugaccucuguuacccaggggauuucaaugacuaugaagaauugaaacaccuauugagcagaauaaaccauuuugagaaaauucagaucauucccaaaaguucuuggcccagucaugaagccucauugggggugagcgcagcauguccauaccaggggaaguccucuuuuuucagaaaugugguauggcuuaucaaaaagaacaacacauacccaacaauaaagaggagcuacaauaauaccaaccaagaagaucuuuugguaaugugggggauccaccauccuaaugaugcggcagagcagacaaaucucuaucaaaauccaaccaccuauauuuccguugggacaucaacacuaaaccagagauugacaccaagaauagcuacuagauccaaaguaaacgggcaaagugggagaauggaguucuucuggacaauuuuaaaaccgaaugaugcaaucaacuucgagaguaauggaaacuucauugcuccagaguaugcauacaaaauugucaagaaaggggacucaacaauuaugaaaagugaauuagaauaugguaacugcaacaccaagugucaaacuccaaugggggcgauaaacucuaguaugccauuccacaauauacauccucucaccauuggggaaugccccaaauaugugaaaucaaacagauuaguccuugcgacugggcucagaaauagcccucaaagagagggaagaagaaaaaagagaggauuauuuggagcuauagcagguuucauagagggaggauggcagggaaugguagaugguugguauggguaccaccauagcaaugagcaggggaguggguacgcugcagacaaagaauccacucaaaaggcuauagauggagucaccaauaaggucaacucgaucauugacaaaaugaacacucaguuugaggccguuggaagggaauuuaacaacuuagaaaggagaauagagaauuuaaacaagaagauggaagacggguuccuggaugucuggacuuauaaugcugaacuucugguucucauggaaaaugagagaacucuggacuuccaugacucaaauguaaagaaccuuuacgacaagguccgauuacagcuuagggauaaugcaaaggagcuggguaacgguuguuucgaguucuaucacaaaugugauaaugaauguauggaaagugugagaaacgggacguaugacuauccgcaguauucagaagaagcaagauuaaaaagagaggaaauaaguggagugaaauuggaaucaauaggaauuuaccaaauacugucaauuuauucuacaguggcgaguucucuagcacuggcaaucaugguagcuggucuauccuuguggaugugcuccaaugggucguuacaaugcagaauuugcauuuaa

SEQ ID NO: 36348 - RNA, 1701 nt, Artificial Sequence; identical to SEQ ID NO: 33173
  hemagglutinin__InfluenzaA__ADM95745

SEQ ID NO: 36349 - RNA, 1701 nt, Artificial Sequence; identical to SEQ ID NO: 33173
  hemagglutinin__InfluenzaA__ADM95746

SEQ ID NO: 36350 - RNA, 1701 nt, Artificial Sequence; identical to SEQ ID NO: 33173
  hemagglutinin__InfluenzaA__ADM95747

SEQ ID NO: 36351 - RNA, 1701 nt, Artificial Sequence
  hemagglutinin__InfluenzaA__ADM95749
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugugauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36352 - RNA, 1701 nt, Artificial Sequence
  hemagglutinin__InfluenzaA__ADM95750
augaaggcaauacuaguaguucugcuauauacauuugcaaccgcaaaugcagacacauuauguauagguuaucaugcgaacaauucaacagacacuguagacacaguacuagaaaagaauguaacaguaacacacucuuuuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguagaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaguucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuucuuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacuugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36353 - RNA, 1701 nt, Artificial Sequence
  hemagglutinin__InfluenzaA__ADM95751
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggggcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36354 - RNA, 1701 nt, Artificial Sequence; identical to SEQ ID NO: 34363
  hemagglutinin__InfluenzaA__ADM95752

SEQ ID NO: 36355 - RNA, 1701 nt, Artificial Sequence; identical to SEQ ID NO: 33173
  hemagglutinin__InfluenzaA__ADM95753

SEQ ID NO: 36356 - RNA, 1701 nt, Artificial Sequence; identical to SEQ ID NO: 34363
  hemagglutinin__InfluenzaA__ADM95754

SEQ ID NO: 36357 - RNA, 1701 nt, Artificial Sequence
  hemagglutinin__InfluenzaA__ADM95755
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaaucccgagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36358 - RNA, 1701 nt, Artificial Sequence
  hemagglutinin__InfluenzaA__ADM95757
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccagcucauugguacugguagucucccugggggcaaucaguuucuggaugugcucuaaugggucucuacaguguagaauauguauuuaa

SEQ ID NO: 36359 - RNA, 1701 nt, Artificial Sequence; identical to SEQ ID NO: 33173
  hemagglutinin__InfluenzaA__ADM95758

SEQ ID NO: 36360 - RNA, 1701 nt, Artificial Sequence
  hemagglutinin__InfluenzaA__ADM95759
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacuauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36361 - RNA, 1701 nt, Artificial Sequence
  hemagglutinin__InfluenzaA__ADM95760
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaauuaaaaaacaaugccaaggaaauuggaaacggcugcuuugaauuuuaccacaaaugcgauaacacaugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucucugggggcaaucaguuucuggaugugcucuaaugggucucuacaguguagaauauguauuuaa

SEQ ID NO: 36362 - RNA, 1701 nt, Artificial Sequence; identical to SEQ ID NO: 34363
  hemagglutinin__InfluenzaA__ADM95761

SEQ ID NO: 36363 - RNA, 1701 nt, Artificial Sequence
  hemagglutinin__InfluenzaA__ADM95763
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagaauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagcagaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36364 - RNA, 1701 nt, Artificial Sequence; identical to SEQ ID NO: 33173
  hemagglutinin__InfluenzaA__ADM95764

SEQ ID NO: 36365 - RNA, 1701 nt, Artificial Sequence; identical to SEQ ID NO: 33173
  hemagglutinin__InfluenzaA__ADM95765

SEQ ID NO: 36366 - RNA, 1701 nt, Artificial Sequence; identical to SEQ ID NO: 33173
  hemagglutinin__InfluenzaA__ADM95767

SEQ ID NO: 36367 - RNA, 1701 nt, Artificial Sequence; identical to SEQ ID NO: 36316
  hemagglutinin__InfluenzaA__ADM95768

SEQ ID NO: 36368 - RNA, 1701 nt, Artificial Sequence; identical to SEQ ID NO: 34264
  hemagglutinin__InfluenzaA__ADM95769

SEQ ID NO: 36369 - RNA, 1701 nt, Artificial Sequence
  hemagglutinin__InfluenzaA__ADM95771
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuccuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauuaagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagagaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaauugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36370 - RNA, 1701 nt, Artificial Sequence
  hemagglutinin__InfluenzaA__ADM95772
augaaggcaauacuaguaguucugcuauauacauuugcaaccgcaaaugcagacacauuauguauagguuaucaugcuaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccuaggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugugauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36371 - RNA, 1701 nt, Artificial Sequence; identical to SEQ ID NO: 33206
  hemagglutinin__InfluenzaA__ADM95774

SEQ ID NO: 36372 - RNA, 1701 nt, Artificial Sequence
  hemagglutinin__InfluenzaA__ADM95775
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaauuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36373 - RNA, 1701 nt, Artificial Sequence
  hemagglutinin__InfluenzaA__ADM95776
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauccaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36374 - RNA, 1701 nt, Artificial Sequence
  hemagglutinin__InfluenzaA__ADM95778
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagauaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaaccuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36375 - RNA, 1701 nt, Artificial Sequence
  hemagglutinin__InfluenzaA__ADM95779
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccuagugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaccaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36376 - RNA, 1701 nt, Artificial Sequence
  hemagglutinin__InfluenzaA__ADM95780
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaaccuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36377 - RNA, 1701 nt, Artificial Sequence
  hemagglutinin__InfluenzaA__ADM95783
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguggauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36378 - RNA, 1701 nt, Artificial Sequence
  hemagglutinin__InfluenzaA__ADM95784
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucauccuuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcgauaaacaccagccuaccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36379 - RNA, 1701 nt, Artificial Sequence; identical to SEQ ID NO: 33206
  hemagglutinin__InfluenzaA__ADM95785

SEQ ID NO: 36380 - RNA, 1701 nt, Artificial Sequence
  hemagglutinin__InfluenzaA__ADM95786
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauagcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguucucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36381 - RNA, 1701 nt, Artificial Sequence; identical to SEQ ID NO: 36376
  hemagglutinin__InfluenzaA__ADM95788

SEQ ID NO: 36382 - RNA, 1701 nt, Artificial Sequence
  hemagglutinin__InfluenzaA__ADM95789
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaaccuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaauggaacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36383 - RNA, 1701 nt, Artificial Sequence
  hemagglutinin__InfluenzaA__ADM95790
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacauguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagaaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36384 - RNA, 1701 nt, Artificial Sequence; identical to SEQ ID NO: 36383
  hemagglutinin__InfluenzaA__ADM95791

SEQ ID NO: 36385 - RNA, 1701 nt, Artificial Sequence; identical to SEQ ID NO: 36383
  hemagglutinin__InfluenzaA__ADM95792

SEQ ID NO: 36386 - RNA, 1701 nt, Artificial Sequence
  hemagglutinin__InfluenzaA__ADM95793
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcaugcccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuugugggaacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaaauuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagauggaguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36387 - RNA, 1701 nt, Artificial Sequence
  hemagglutinin__InfluenzaA__ADM95794
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauugggaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauauucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36388 - RNA, 1701 nt, Artificial Sequence
  hemagglutinin__InfluenzaA__ADM95795
augaaggcaauacuaguaguuuugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36389 - RNA, 1701 nt, Artificial Sequence
  hemagglutinin__InfluenzaA__ADM95798
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucaggcaauggaacguguuacccaggagauuucaucgauuaugaggagcuaagagagcaauugagcucagugucaucauuugaaagguuugagauauuccccaagacaagcucauggcccaaucaugacucgaacaaagguguaacggcagcauguccucaugcuggagcaaaaagcuucuacaaaaauuuaauauggcuaguuaaaaaaggaaacucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36390 - RNA, 1701 nt, Artificial Sequence
  hemagglutinin__InfluenzaA__ADM95799
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcgauaaacaccagccuaccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauugaaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36391 - RNA, 1701 nt, Artificial Sequence
  hemagglutinin__InfluenzaA__ADM95800
augaaggcaauacuaguaguucugcuauauacauuugcaaccgcaaaugcagacacauuauguauagguuaucaugcgaacaauucaacagacacuguagauacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagcgccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgacaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36392 - RNA, 1701 nt, Artificial Sequence; identical to SEQ ID NO: 36376
  hemagglutinin__InfluenzaA__ADM95801

SEQ ID NO: 36393 - RNA, 1701 nt, Artificial Sequence; identical to SEQ ID NO: 36376
  hemagglutinin__InfluenzaA__ADM95802

SEQ ID NO: 36394 - RNA, 1701 nt, Artificial Sequence; identical to SEQ ID NO: 36380
  hemagglutinin__InfluenzaA__ADM95803

SEQ ID NO: 36395 - RNA, 1701 nt, Artificial Sequence
  hemagglutinin__InfluenzaA__ADM95804
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcaugcccucaugcuggagcaaaaaacuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuugugggaacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaaauuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagauggaguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36396 - RNA, 1701 nt, Artificial Sequence
  hemagglutinin__InfluenzaA__ADM95805
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuucccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagaauggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36397 - RNA, 1701 nt, Artificial Sequence
  hemagglutinin__InfluenzaA__ADM95808
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggagauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36398 - RNA, 1701 nt, Artificial Sequence; identical to SEQ ID NO: 36397
  hemagglutinin__InfluenzaA__ADM95809

SEQ ID NO: 36399 - RNA, 1701 nt, Artificial Sequence
  hemagglutinin__InfluenzaA__ADM95810
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugcgaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggagauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36400 - RNA, 1701 nt, Artificial Sequence
  hemagglutinin__InfluenzaA__ADM95812
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaauuacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36401 - RNA, 1701 nt, Artificial Sequence; identical to SEQ ID NO: 36386
  hemagglutinin__InfluenzaA__ADM95816

SEQ ID NO: 36402 - RNA, 1701 nt, Artificial Sequence; identical to SEQ ID NO: 36386
  hemagglutinin__InfluenzaA__ADM95819

SEQ ID NO: 36403 - RNA, 1701 nt, Artificial Sequence; identical to SEQ ID NO: 36396
  hemagglutinin__InfluenzaA__ADM95820

SEQ ID NO: 36404 - RNA, 1701 nt, Artificial Sequence; identical to SEQ ID NO: 36386
  hemagglutinin__InfluenzaA__ADM95821

SEQ ID NO: 36405 - RNA, 1701 nt, Artificial Sequence; identical to SEQ ID NO: 36397
  hemagglutinin__InfluenzaA__ADM95822

SEQ ID NO: 36406 - RNA, 1701 nt, Artificial Sequence; identical to SEQ ID NO: 36397
  hemagglutinin__InfluenzaA__ADM95823

SEQ ID NO: 36407 - RNA, 1701 nt, Artificial Sequence
  hemagglutinin__InfluenzaA__ADM95824
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucauugauuaugaggagcuaagagagcaauugagcucagugucaucauuugaaagguuugagauauuucccaaaacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuaucacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagaauggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36408 - RNA, 1701 nt, Artificial Sequence; identical to SEQ ID NO: 36386
  hemagglutinin__InfluenzaA__ADM95825

SEQ ID NO: 36409 - RNA, 1701 nt, Artificial Sequence
  hemagglutinin__InfluenzaA__ADM95826
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcaugcccucaugcuggagcaaaaagcuucuacaaaaauuuaauauggcuaguuaaaaaaggaaauucauacccaaagcucagcaaauccuacauuaaugauaaagggaaagaaguccucguacuauggggcauucaccauccaucuacuagugcugaccaacaaagucucuaucagaaugcagaugcauauguuuuugugggaacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaaauuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagauggaguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36410 - RNA, 1701 nt, Artificial Sequence
  hemagglutinin__InfluenzaA__ADM95827
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaaaagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggaauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36411 - RNA, 1701 nt, Artificial Sequence
  hemagglutinin__InfluenzaA__ADM95828
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuucccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccagcccacgauugcaauacaacuugucagacacccaagggugcuauaaacaccagccucccauuucagaauauacauccgaucacaauuggaaaauguccaaaauauguaaaaagcacaaaauugagaauggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36412 - RNA, 1701 nt, Artificial Sequence
  hemagglutinin__InfluenzaA__ADM95829
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcaugcccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuugugggaacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaaauuauaugaaaagguaagaagccaguuaaaaaacaaugccaaggaaauuggaaacggcugcuuugaauuuuaccacaaaugcgauaacaugugcauggaaagugucaaaaaugggacuuaugacuacccaaaauacucagaggaagcaaaauuaaacagagaagaaauagauggaguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36413 - RNA, 1701 nt, Artificial Sequence
  hemagglutinin__InfluenzaA__ADM95831
augaaggcaauacuaguaguucugcuauauacauuuguaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggaauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaaaaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacuugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36414 - RNA, 1701 nt, Artificial Sequence; identical to SEQ ID NO: 36397
  hemagglutinin__InfluenzaA__ADM95832

SEQ ID NO: 36415 - RNA, 1701 nt, Artificial Sequence
  hemagglutinin__InfluenzaA__ADM95833
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuucccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugacaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagaauggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36416 - RNA, 1701 nt, Artificial Sequence; identical to SEQ ID NO: 36400
  hemagglutinin__InfluenzaA__ADM95834

SEQ ID NO: 36417 - RNA, 1701 nt, Artificial Sequence; identical to SEQ ID NO: 36396
  hemagglutinin__InfluenzaA__ADM95836

SEQ ID NO: 36418 - RNA, 1701 nt, Artificial Sequence; identical to SEQ ID NO: 36386
  hemagglutinin__InfluenzaA__ADM95837

SEQ ID NO: 36419 - RNA, 1701 nt, Artificial Sequence
  hemagglutinin__InfluenzaA__ADM95838
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcaugucuucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacgaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36420 - RNA, 1701 nt, Artificial Sequence; identical to SEQ ID NO: 36396
  hemagglutinin__InfluenzaA__ADM95839

SEQ ID NO: 36421 - RNA, 1701 nt, Artificial Sequence
  hemagglutinin__InfluenzaA__ADM95840
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguucucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36422 - RNA, 1701 nt, Artificial Sequence; identical to SEQ ID NO: 36421
  hemagglutinin__InfluenzaA__ADM95842

SEQ ID NO: 36423 - RNA, 1701 nt, Artificial Sequence; identical to SEQ ID NO: 36386
  hemagglutinin__InfluenzaA__ADM95843

SEQ ID NO: 36424 - RNA, 1701 nt, Artificial Sequence; identical to SEQ ID NO: 36386
  hemagglutinin__InfluenzaA__ADM95844

SEQ ID NO: 36425 - RNA, 1701 nt, Artificial Sequence
  hemagglutinin__InfluenzaA__ADM95845
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucauugauuaugaggagcuaagagagcaauugagcucagugucaucauuugaaagguuugagauauuucccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagaauggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaaacaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36426 - RNA, 1701 nt, Artificial Sequence
  hemagglutinin__InfluenzaA__ADM95846
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaagcaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggagauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36427 - RNA, 1701 nt, Artificial Sequence; identical to SEQ ID NO: 36397
  hemagglutinin__InfluenzaA__ADM95847

SEQ ID NO: 36428 - RNA, 1701 nt, Artificial Sequence; identical to SEQ ID NO: 36399
  hemagglutinin__InfluenzaA__ADM95848

SEQ ID NO: 36429 - RNA, 1701 nt, Artificial Sequence
  hemagglutinin__InfluenzaA__ADM95849
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcaugcccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuugugggaacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaaauuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagauggaguaaagcuggaaucaacaaggauuuaccagauuuuggcgaucuauucaacugucgccaguucauugguacugguaaucucccugggggcaaucaguuucuggaugugcucuaaugggucucuacaguguagaauauguauuuaa

SEQ ID NO: 36430 - RNA, 1701 nt, Artificial Sequence; identical to SEQ ID NO: 36386
  hemagglutinin__InfluenzaA__ADM95850

SEQ ID NO: 36431 - RNA, 1701 nt, Artificial Sequence
  hemagglutinin__InfluenzaA__ADM95851
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacaacaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggagauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauucuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36432 - RNA, 1701 nt, Artificial Sequence
  hemagglutinin__InfluenzaA__ADM95852
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcaugcccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuugugggaacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaaauuauaugaaaagauaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagauggaguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36433 - RNA, 1701 nt, Artificial Sequence; identical to SEQ ID NO: 35786
  hemagglutinin__InfluenzaA__ADM95854

SEQ ID NO: 36434 - RNA, 1701 nt, Artificial Sequence
  hemagglutinin__InfluenzaA__ADM95855
augaaggcaauacuaguaguucugcuauauacauuugcaaccacaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcaugcccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuugugggaacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaaauuauaugaaaagguaagaagccaguuaaaaaacaaugccaaggaaauuggaaacggcugcuuugaauuuuaccacaaaugcgauaacacgugcauggaaagugucaaaaaugggacuuaugacuauccaaaauacucagaggaagcaaaauuaaacagagaagaaauagauggaguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36435 - RNA, 1701 nt, Artificial Sequence
  hemagglutinin__InfluenzaA__ADM95857
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaacucaugguccuacauuguggaaacaucuaguucagacaauggaacguguuacccaggagauuucaucgauuaugaggagcuaagagagcaauugagcucagugucaucauuugaaagguuugagauauuucccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagaauggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36436 - RNA, 1701 nt, Artificial Sequence
  hemagglutinin__InfluenzaA__ADM95858
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuucccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagaauggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaauuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36437 - RNA, 1701 nt, Artificial Sequence
  hemagglutinin__InfluenzaA__ADM95859
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgagaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaagagcuaagagagcaauugagcucagugucaucauuugaaagguuugagauauuccccaagacaaguucauggcccaaucaugacucgaacaaagguguaacggcagcaugcccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuugugggaacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaaauuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagauggaguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36438 - RNA, 1701 nt, Artificial Sequence
  hemagglutinin__InfluenzaA__ADM95860
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauuuggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauuagacccaaagugagggaucaagaagggagaaugaacuauuacuggacacuaguagagccgggagacaaaauaacauucgaagcaacuggaaaucuagugguaccaagauaugcauucgcaauggaaagaaaugcuggaucugguauuaucauuucagauacaccaguccaugauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaauucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaguuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuucuggaugugcucuaaugggucucuacaguguagaauauguauuuaa

SEQ ID NO: 36439 - RNA, 1701 nt, Artificial Sequence
  hemagglutinin__InfluenzaA__ADM95862
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaauuacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuuuauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36440 - RNA, 1701 nt, Artificial Sequence
  hemagglutinin__InfluenzaA__ADM95864
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccuagugcuauggggcauucaccauccaucuacuagugcugaccaacaaagucucuaucagaaugcagaugcauauguuuuuguggggacaucaagauacagcaagaaguucaagccggaaauagcaauaagacccagagugagggaucaagaagggagaaugaacuaucacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucaaaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36441 - RNA, 1701 nt, Artificial Sequence
  hemagglutinin__InfluenzaA__ADM95865
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcugcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccauccacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaucacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36442 - RNA, 1701 nt, Artificial Sequence
  hemagglutinin__InfluenzaA__ADM95866
augaaggcaauacuaguaguucugcuauauacauuugcaaccacaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaauaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaagggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggucacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugagaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuucuggaugugcucuaaugggucucuacaguguagaauauguauuuaa

SEQ ID NO: 36443 - RNA, 1698 nt, Artificial Sequence
  hemagglutinin__InfluenzaA__ADN06300
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaagagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggagaaagcaguuuuuacagaaauuugcuauggcugacggggaagaaugguuuguauccaaaucugagcaaguccuaugcaaacaacaaagaaaaagaaguccuuguacuaugggguguucaucacccgccaaacauaguugaccaaaagacccucuaccguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggguaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucaggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgauauacucaacagucgccaguucucugguucuuuuggucucccugggggcaaucagcuucuggauguguuccaaugggucuuugcaguguagaauaugcaucuaa

SEQ ID NO: 36444 - RNA, 1698 nt, Artificial Sequence
  hemagglutinin__InfluenzaA__ADN06311
augaaaguaaaacuacugguccuguuaugcacacuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauugcugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaaggaagcucauggcccaaccacaccguaaccggagugucagcaucaugcucccauaauggggaaaacaguuuuuacagaaauuugcuauggcugacggggaagaaugguuuguacccaaaccugagcaaguccuaugcaaacaacaaagaaaaagaaguccuuguacuaugggguguucaucacccgccaaacauagcugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucaaggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggauuuauagacauuuggacauauaaugcagaacuguugguuuuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaauguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucucuuggucucccugggggcaaucagcuucuggauguguuccaaugggucuuugcaguguagaauaugcaucuaa

SEQ ID NO: 36445 - RNA, 1698 nt, Artificial Sequence
  hemagglutinin__InfluenzaA__ADN06322
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaagagucaugguccuacauuguagaaaaaccaaauccugagaauggaacauguuauccagggcauuucgcugacuaugaggaacugagagagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacaugguugaccaaaggacccucuaccguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggguaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36446 - RNA, 1698 nt, Artificial Sequence
  hemagglutinin__InfluenzaA__ADN06344
augaagguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaagcauaagugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcaccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauacuccgaagaaucgaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36447 - RNA, 1701 nt, Artificial Sequence; identical to SEQ ID NO: 36037
  hemagglutinin__InfluenzaA__ADN06366

SEQ ID NO: 36448 - RNA, 1701 nt, Artificial Sequence
  hemagglutinin__InfluenzaA__ADN26165
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaaggcaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaauuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucagcaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36449 - RNA, 1701 nt, Artificial Sequence; identical to SEQ ID NO: 34836
  hemagglutinin__InfluenzaA__ADN26175

SEQ ID NO: 36450 - RNA, 1701 nt, Artificial Sequence
  hemagglutinin__InfluenzaA__ADN78194
augaaggcaauacuaguaguucugcuauauacauuugcaaccacaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccuaccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuacuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36451 - RNA, 1701 nt, Artificial Sequence
  hemagglutinin__InfluenzaA__ADN78195
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccuaccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36452 - RNA, 1701 nt, Artificial Sequence; identical to SEQ ID NO: 34731
  hemagglutinin__InfluenzaA__ADN78212

SEQ ID NO: 36453 - RNA, 1701 nt, Artificial Sequence; identical to SEQ ID NO: 34731
  hemagglutinin__InfluenzaA__ADN78221

SEQ ID NO: 36454 - RNA, 1698 nt, Artificial Sequence; identical to SEQ ID NO: 36444
  hemagglutinin__InfluenzaA__ADN89050

SEQ ID NO: 36455 - RNA, 1698 nt, Artificial Sequence
  hemagglutinin__InfluenzaA__ADN89061
augaaaguaaaacuacugguccuguuaugcacauucacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuauugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggagaagaaugguuuguacccgaaccugagcaaguccuaugcaaacaacaaagaaaaagaaguccuuguacuaugggguguucaucacccgccaagcauaagugaccaaaaaacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugagauuacaaacaaggugaauucaguaauugagaaaaugaacacucaauucacagcagugggcaaagaauucaacaaauuggaaagaaggauggaaaacuugaacaaaaaaguugaugauggguuuauagacauuuggacauauaaugcagaacuguugguucuacuggaaaaugaaaggacuuuggauuuccaugacuccaaugugaagaaucuguaugagaaaguaaaaaaccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36456 - RNA, 1698 nt, Artificial Sequence
  hemagglutinin__InfluenzaA__ADN89072
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaagcauaagugaccaaaagacccucuaucauacagaaaaugcuuauguuucuguagugucuucacauuauagcagaaaauucaccccagaaauagccaaaagaccuaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaauguagaauaugcaucuaa

SEQ ID NO: 36457 - RNA, 1698 nt, Artificial Sequence
  hemagglutinin__InfluenzaA__ADN89083
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucauggucauacauuguagaaaaaccaaauccugagaauggaacauguuacccaggacauuucgcugacuaugaggaacugagggagcaauugaguucaguaucuucauuugagagguucgaaauauuccccaaagaaagcucauggcccaaccacaccguaaccggagugucagcaucaugcucccauaauggggaaaacaguuuuuacagaaauuugcuauggcugacggggaagaaugguuuguacccaaaccugagcaaguccuaugcaaacaacaaagaaaaagaaguccuuguacuaugggguguucaucacccgccaaacauggcugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucaaggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagagcuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36458 - RNA, 1698 nt, Artificial Sequence
  hemagglutinin__InfluenzaA__ADN89094
augaaaguaaaacuacugguccuguuaugcacauuuacagcuacauaugcggacacaauauguauaggcuaccaugcuaacaacucgaccgacacuguugacacagcacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaaacaguuuuuacagaaauuugcuauggcugacggggaagaaugguuuguacccaaaccugagcaaguccuaugcaaacaacaaaggaaaagaaguccuuguacuaugggguguucaucacccgccaaacauagcugaucaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucaaggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaacggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauuuuggcgaucuacucaacagucgccaguucucugguucuuuuggucucccugggggcaaucagcuucuggauguguuccaaugggucuuugcaguguagaauaugcaucuaa

SEQ ID NO: 36459 - RNA, 1698 nt, Artificial Sequence
  hemagglutinin__InfluenzaA__ADN89116
augaaaguaaaacuacugauccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaaugggaaacuauguuuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggugaagaaugguuuguacccaaacuugagcaaguccuaugcaaacaacaaagaaaaagaaguccuuguacuaugggguguucaucacccgccaaacauaguugaccaaaagacccucuaucguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucggggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaauuuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaaccuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36460 - RNA, 1698 nt, Artificial Sequence
  hemagglutinin__InfluenzaA__ADN89127
augaaaguaaaacuacugguccuguuaugcacacuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauugcugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaaggaagcucauggcccaaccacaccguaaccggagugucagcaucaugcucccauaauggggaaaacaguuuuuacagaaauuugcuauggcugacggggaagaaugguuuguacccaaaccugagcaaguccuaugcaaacaacaaagaaaaagaaguccuuguacuaugggguguucaucacccgccaaacauagcugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucaaggagcuauaaacagcagucuuccuuuccagaacguacacccagucacgauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggauuuauagacauuuggacauauaaugcagaacuguugguuuuacuggaaaaugaaaggacuuuggauuuccaugacuccaaugugaagaaucuguaugagaaaguaaaaagccaguuaaagaauaaugcugaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucucuuggucucccugggggcaaucagcuucuggauguguuccaaugggucuuugcaguguagaauaugcaucuaa

SEQ ID NO: 36461 - RNA, 1698 nt, Artificial Sequence
  hemagglutinin__InfluenzaA__ADN89149
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccauuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggagaagaaugguuuguacccaaaccugagcaaguccuaugcaaacaacaaagaaaaagaaguccuuguacuaugggguguucaucacccgccaagcauaagugaucaaaagacccucuaucauacagaaaaugcuuauguuucuguagugucuucacauuauagcagaaaauucaccccagaaguagccaaaagacccaaaguaagggaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagacgguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaguauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuga

SEQ ID NO: 36462 - RNA, 1698 nt, Artificial Sequence; identical to SEQ ID NO: 36035
  hemagglutinin__InfluenzaA__ADN89171

SEQ ID NO: 36463 - RNA, 1698 nt, Artificial Sequence
  hemagglutinin__InfluenzaA__ADN89182
augaaaguaaaacuacugguccuguuaugcacacuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugccuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaguugaccaaaagacccucuaucguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaaaugccaaacaccucagggagcuauaaacaguagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggagagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36464 - RNA, 1698 nt, Artificial Sequence; identical to SEQ ID NO: 36035
  hemagglutinin__InfluenzaA__ADN89193

SEQ ID NO: 36465 - RNA, 1698 nt, Artificial Sequence; identical to SEQ ID NO: 36035
  hemagglutinin__InfluenzaA__ADN89204

SEQ ID NO: 36466 - RNA, 1698 nt, Artificial Sequence
  hemagglutinin__InfluenzaA__ADN89215
augaaaguaaaacuacugguccuguuaugcacacuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauugcugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaaggaagcucauggcccaaccacaccguaaccggagugucagcaucaugcucccauaauggggaaaacaguuuuuacagaaauuugcuauggcugacggggaagaaugguuuguacccaaaccugagcaaguccuaugcaaacaacaaagaaaaagaaguccuuguacuaugggguguucaucacccgccaaacauagcugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucaaggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggauuuauagacauuuggacauauaaugcagaacuguugguuuuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucucuuggucucccugggggcaaucagcuucuggauguguuccaaugggucuuugcaguguagaauaugcaucuaa

SEQ ID NO: 36467 - RNA, 1698 nt, Artificial Sequence
  hemagglutinin__InfluenzaA__ADN89226
augaaaguaaaacuacugguccuguuaugcacauuugcagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuauugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggagaagaaugguuuguacccgaaccugagcaaguccuaugcaaacaacaaagaaaaagaaguccuuguacuaugggguguucaucacccgccaagcauaagugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaauagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccguucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaguuggaaagaaggauggaaaacuugaacaaaaagguugaugauggguuuauagacauuuggacauauaaugcagaacuguugguucuacuggaaaaugaaaggacuuuggauuuccaugacuccaaugugaagaaucuguaugagaaaguaaaaaaccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36468 - RNA, 1698 nt, Artificial Sequence; identical to SEQ ID NO: 36466
  hemagglutinin__InfluenzaA__ADN89237

SEQ ID NO: 36469 - RNA, 1698 nt, Artificial Sequence
  hemagglutinin__InfluenzaA__ADN89248
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcauugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaagcauaagugaccaaaagacccucuaucauacagaaaaugcuuauguuucuguagugucuucacauuauagcagaaaauucaccccagaaauagccaaaagaccuaaaguaagagaucaagaaggaagaaucaacuacuacuggacucugcuugaacccggggacacaauaauauuugaggcaaauggaaaccuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucagaagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36470 - RNA, 1698 nt, Artificial Sequence; identical to SEQ ID NO: 36457
  hemagglutinin__InfluenzaA__ADN89259

SEQ ID NO: 36471 - RNA, 1698 nt, Artificial Sequence
  hemagglutinin__InfluenzaA__ADN89281
augaaaguaaaacuacugguccuguuaugcacauucacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuacuaaaaggaauagccccacuacaauuggguaacugcagcguugccggguggauauuaggaaacccagaaugcgaauuauugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggagaagaaugguuuguacccgaaccugagcaaguccuaugcaaacaacaaagaaaaagaaguccuuguacuaugggguguucaucacccaccaagcauaagugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaacucuguaauugagaaaaugaacacucaauucacagcagugggcaaagaauucaacaaauuggaaagaaggauggaaaacuugaacaaaaaaguugaugauggguuuauagacauuuggacauauaaugcagaacuguugguucuacuggaaaaugaaaggacuuuggauuuccaugacuccaaugugaagaaucuguaugagaaaguaaaaaaccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucuuugguucuuuuggucucccugggggcaaucagcuucuggauguguuccaaugggucuuugcaguguagaauaugcaucuaa

SEQ ID NO: 36472 - RNA, 1698 nt, Artificial Sequence; identical to SEQ ID NO: 36471
  hemagglutinin__InfluenzaA__ADN89292

SEQ ID NO: 36473 - RNA, 1698 nt, Artificial Sequence; identical to SEQ ID NO: 36471
  hemagglutinin__InfluenzaA__ADN89303

SEQ ID NO: 36474 - RNA, 1698 nt, Artificial Sequence
  hemagglutinin__InfluenzaA__ADN89314
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaaacagcuuuuacagaaauuugcuauggcugacggggaagaaugguuuguacccaaaccugagcaaguccuaugcaaacaacaaagaaaaagaaguccuuguacuaugggguguucaucacccgccaaacauagcugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucaaggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggauuuauagacauuuggacauauaaugcagaacuguugguuuuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucucuuggucucccugggggcaaucagcuucuggauguguuccaaugggucuuugcaguguagaauaugcaucuaa

SEQ ID NO: 36475 - RNA, 1698 nt, Artificial Sequence; identical to SEQ ID NO: 34614
  hemagglutinin__InfluenzaA__ADN89325

SEQ ID NO: 36476 - RNA, 1698 nt, Artificial Sequence
  hemagglutinin__InfluenzaA__ADN89336
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacugugucuauuaaaaggaauagccccacuacaauuggguaacugcagcguugccggguggaucuuaggaaauccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagaaguuuuuacagaaauuugcuauggcugacggggaagaaugguuuguacccaaaccugagcaaguccuaugcaaacaacaaagaaaaagaaguccuuguacuaugggguguucaucacccgccagacauaggugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacuggacuaaggaacaucccauccauucaauccagagguuuguuuggagccauugccgguuucauugaagggggguggacuggaaugguagaugguugguaugguuaucaucaucagaaugagcaagggucuggcuaugcugcagaucaaaaaagcacacaaaaugccauuaaugggauuacaaacaaggugaauucuguaauugagaaaaugaacacucaguucacagcagugggcaaagaauucaauaaauuggaaagaaggauggaaaacuugaauaaaaaaguugaugauggauuuauagacauuuggacauauaaugcagaacuguugguucuacuggaaaaugaaaggacuuuggauuuccaugauuccaaugugaagaaucuguaugagaaaguaaaaagccaguuaaagaauaaugcuaaagaaauaggaaauggguguuuugaauucuaucacaaguguaacgaugagugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucaguuucuggauguguuccaaugggucuuugcaguguagaauaugcaucuaa

SEQ ID NO: 36477 - RNA, 1698 nt, Artificial Sequence; identical to SEQ ID NO: 36467
  hemagglutinin__InfluenzaA__ADN89347

SEQ ID NO: 36478 - RNA, 1698 nt, Artificial Sequence; identical to SEQ ID NO: 34614
  hemagglutinin__InfluenzaA__ADN89358

SEQ ID NO: 36479 - RNA, 1698 nt, Artificial Sequence
  hemagglutinin__InfluenzaA__ADN89369
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaaugggaaacuauguuuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggugaagaaugguuuguacccaaacuugagcaaguccuaugcaaacaacaaagaaaaagaaguccuuguacuaugggguguucaucacccgccaaacauaguugaccaaaagacccucuaucguacagaaaaugcuuauguuucuguagugucuucacauuauagcagaaaauucaucccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucggggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaaccuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36480 - RNA, 1698 nt, Artificial Sequence
  hemagglutinin__InfluenzaA__ADN89380
augaaaguaaaacuacugguccuguuaugcacacuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugccuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaguugaccaaaagacccucuaucguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaaaugccaaacaccucagggagcuauaaacaguagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggagagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacaaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36481 - RNA, 1698 nt, Artificial Sequence
  hemagglutinin__InfluenzaA__ADN89391
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacugugucuauuaaaaggaauagccccacuacaauuggguaacugcagcguugccggguggaucuuaggaaauccagaaugcgaauuacugauuuccaaggagucaugguccuacauuguagaaaaaccaaacccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagaaguuuuuacaaaaauuugcuauggcugacggggaagaaugguuuguacccaaaccugagcaaguccuaugcaaacaacaaagaaaaagaaguccuuguacuaugggguguucaucacccgccagacauaggugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacuggacuaaggaacaucccauccauucaauccagagguuuguuuggagccauugccgguuucauugaagggggguggacuggaaugguagauggcugguaugguuaucaucaucagaaugagcaagggucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugauuccaaugugaagaaucuguaugagaaaguaaaaagccaguuaaagaauaaugcuaaagaaauaggaaauggguguuuugaauucuaucacaaguguaacgaugagugcauggagaguguaaagaauggaacuuaugacuauccaaaauauuccgaagaaucaaaguuaaacagggagaaaauugauggggugaaauuggaaucaaugggagucuaucagauucuggcgaucuacucaacagucgccaguucucugguucuuuuggucucccugggggcaaucaguuucuggauguguuccaaugggucuuugcaguguagaauaugcaucuaa

SEQ ID NO: 36482 - RNA, 1698 nt, Artificial Sequence
  hemagglutinin__InfluenzaA__ADN89402
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaaaagucaugguccuacauuguagaaaaaccaaauccugagaauggaacauguuacccagggcauuucgcugacuaugaggaacugaaggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaguugaccaaaagacccucuaccguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggguaaaugugaugcgaagugccagacaccucagggagcuauaaacagcagucuuccuuuccagaacguacacccagucacaauaggagaguguccaaaguaugucaggagugcaaaauuaaggaugguuacaggacuaaggaacaucccauccauucaaucuagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36483 - RNA, 1698 nt, Artificial Sequence; identical to SEQ ID NO: 36444
  hemagglutinin__InfluenzaA__ADN89413

SEQ ID NO: 36484 - RNA, 1698 nt, Artificial Sequence; identical to SEQ ID NO: 36035
  hemagglutinin__InfluenzaA__ADN89424

SEQ ID NO: 36485 - RNA, 1698 nt, Artificial Sequence
  hemagglutinin__InfluenzaA__ADN89435
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugaaaacagucacaauggaaaacuaugucuauuaaaaggaauagccccacuacaauuggguaacugcagcguugccggguggaucuuaggaaacccagaaugcgaauuacugauuuccaaggagucaugguccuacauuguggaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaaacaguuuuuacagaaauuugcuauggcugacggggaagaaugguuuguacccaaaccugagcaaguccuaugcaaacaacaaagaaaaagaaguccuuguacuaugggguguucaucacccgccaaacauagcugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucaaggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguugaugguugguaugguuaucaucaucagaaugagcaaggaucuggcuaugcugcagaucaaaaaagcacacaaaaugccauuaauggaauuacaaacaaggugaauucuguaauugaaaaaaugaacacucaauucacagcagugggcaaagaauucaacaaauuggaaagaaggauggaaaacuugaauaaaaaaguugaugauggauuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaagguuaaacagggagaaaauugauggagugaaauuggaaucaaugggagucuaucagauucuggcgaucuacucaacagucgccaguucucugguucucuuggucucccugggggcaaucagcuucuggauguguuccaaugggucuuugcaguguagaauaugcaucuaa

SEQ ID NO: 36486 - RNA, 1698 nt, Artificial Sequence
  hemagglutinin__InfluenzaA__ADN89446
augaaagcaaaacuacugguccuguuaugcacauuuacagcuacauaugcagacacaauaugcauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaaacaguuuuuacagaaauuugcuauggcugacggggaagaaugguuuguacccaaaccugagcaaguccuaugcaaacaacaaagaaaaagaaguccuuguacuaugggguguucaucacccgccaaacauagcugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucaaggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacccaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36487 - RNA, 1698 nt, Artificial Sequence; identical to SEQ ID NO: 36035
  hemagglutinin__InfluenzaA__ADN89457

SEQ ID NO: 36488 - RNA, 1698 nt, Artificial Sequence
  hemagglutinin__InfluenzaA__ADN89468
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagauagcucauggcccaaccacaccguaaccggagugucagcaucauguucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaagcauaaaugaccaaaagacccucuaucauacagaaaacgcuuauguuucuguagugucuucacauuauagcaggaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucagcaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucugacgaucuacucaacagucgccaguucucugguucuuuugaucucccugggggcaaucagcuucuggauguguuccaaugggucuuugcaguguagaauaugcaucuaa

SEQ ID NO: 36489 - RNA, 1698 nt, Artificial Sequence; identical to SEQ ID NO: 36456
  hemagglutinin__InfluenzaA__ADN89479

SEQ ID NO: 36490 - RNA, 1698 nt, Artificial Sequence; identical to SEQ ID NO: 36446
  hemagglutinin__InfluenzaA__ADN89490

SEQ ID NO: 36491 - RNA, 1698 nt, Artificial Sequence; identical to SEQ ID NO: 36469
  hemagglutinin__InfluenzaA__ADN89501

SEQ ID NO: 36492 - RNA, 1698 nt, Artificial Sequence
  hemagglutinin__InfluenzaA__ADN89512
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccaggacauuucgcugacuaugaggaacugagggagcaauugaguucaguaucuucauuugagagguucgaaauauuccccaaagaaagcucauggcccaaccacaccguaaccggagugucagcaucaugcucccauaauggggaaaacaguuuuuacagaaauuugcuauggcugacggggaagaaugguuuguacccaaaccugagcaaguccuaugcaaacaacaaagaaaaagaaguccuuguacuaugggguguucaucacccgccaaacauggcugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucaaggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36493 - RNA, 1698 nt, Artificial Sequence
  hemagglutinin__InfluenzaA__ADN89523
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuauugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggagaagaaugguuuguacccgaaccugagcaaguccuaugcaaacaacaaagaaaaagaaguccuuguacuaugggguguucaucacccgccaagcauaagugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaacaaaaaaguugaugauggguuuauagacauuuggacauauaaugcagaacuguugguucuacuggaaaaugaaaggacuuuggauuuccaugacuccaaugugaagaaucuguaugagaaaguaaaaaaccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggaguuaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36494 - RNA, 1698 nt, Artificial Sequence; identical to SEQ ID NO: 36480
  hemagglutinin__InfluenzaA__ADN89534

SEQ ID NO: 36495 - RNA, 1698 nt, Artificial Sequence; identical to SEQ ID NO: 36485
  hemagglutinin__InfluenzaA__ADN89545

SEQ ID NO: 36496 - RNA, 1698 nt, Artificial Sequence
  hemagglutinin__InfluenzaA__ADN89556
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccaggacauuucgcugacuaugaggaacugagggagcaauugaguucaguaucuucauuugagagguucgaaauauuccccaaagaaagcucauggcccaaccacaccguaaccggagugucagcaucaugcucccauaauggggaaaacaguuuuuacagaaauuugcuauggcugacggggaagaaugguuuguacccaaaccugagcaaguccuaugcaaacaacaaagaaaaagaaguccuuguacuaugggguguucaucacccgccaaacauagcugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucaaggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucaaaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36497 - RNA, 1698 nt, Artificial Sequence; identical to SEQ ID NO: 36456
  hemagglutinin__InfluenzaA__ADN89567

SEQ ID NO: 36498 - RNA, 1698 nt, Artificial Sequence
  hemagglutinin__InfluenzaA__ADN89578
augaaaguaaaacuacugguccuguuaugcacacuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauugcugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaaggaagcucauggcccaaccacaccguaaccggagugucagcaucaugcucccauaauggggaaaacaguuuuuacagaaauuugcuauggcugacggggaagaaugguuuguacccaaaccugagcaaguccuaugcaaacaacaaagaaaaagaaguccuuuuacuaugggguguucaucacccgccaaacauagcugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucaaggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggauuuauagacauuuggacauauaaugcagaacuguugguuuuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucucuuggucucccugggggcaaucagcuucuggauguguuccaaugggucuuugcaguguagaauaugcaucuaa

SEQ ID NO: 36499 - RNA, 1698 nt, Artificial Sequence
  hemagglutinin__InfluenzaA__ADN89589
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaagagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggagaaagcaguuuuuacagaaauuugcuauggcugacggggaagaaugguuuguauccaaaucugagcaaguccuaugcaaacaacaaagaaaaagaaguccuuguacuaugggguguucaucacccgccaaacauaguugaccaaaagacccuuuaccguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggguaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucaggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgauauacucaacagucgccaguucucugguucuuuuggucucccugggggcaaucagcuucuggauguguuccaaugggucuuugcaguguagaauaugcaucuaa

SEQ ID NO: 36500 - RNA, 1698 nt, Artificial Sequence
  hemagglutinin__InfluenzaA__ADN89600
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaagagucaugguccuacauuguagaaaaaccaaauccugagaauggaacauguuacccagggcauuucgcugacuaugaggaacugagagagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacgaggaagaaugguuuguacccaaaccugagcaaguccuaugcaaacaacaaagaaaaagaaguccuuguacuaugggguguucaucacccgccaaacaugguugaccaaaagacccucuaccguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggguaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36501 - RNA, 1698 nt, Artificial Sequence; identical to SEQ ID NO: 36035
  hemagglutinin__InfluenzaA__ADN89611

SEQ ID NO: 36502 - RNA, 1698 nt, Artificial Sequence; identical to SEQ ID NO: 36444
  hemagglutinin__InfluenzaA__ADN89622

SEQ ID NO: 36503 - RNA, 1698 nt, Artificial Sequence; identical to SEQ ID NO: 36485
  hemagglutinin__InfluenzaA__ADN89633

SEQ ID NO: 36504 - RNA, 1698 nt, Artificial Sequence; identical to SEQ ID NO: 36469
  hemagglutinin__InfluenzaA__ADN89644

SEQ ID NO: 36505 - RNA, 1698 nt, Artificial Sequence
  hemagglutinin__InfluenzaA__ADN89655
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugaaaacagucacaauggaaaacuaugucuauuaaaaggaauagccccacuacaauuggguaacugcagcguugccggguggaucuuaggaaacccagaaugcgaauuacugauuuccaaggagucaugguccuacauuguggaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaaacaguuuuuacagaaauuugcuauggcugacggggaagaaugguuuguacccaaaccugagcaaguccuaugcaaacaacaaagaaaaagaaguccuuguacuaugggguguucaucacccgccaaacauagcugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucuucuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucaaggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguugaugguugguaugguuaucaucaucagaaugagcaaggaucuggcuaugcugcagaucaaaaaagcacacaaaaugccauuaauggaauuacaaacaaggugaauucuguaauugaaaaaaugaacacucaauucacagcagugggcaaagaauucaacaaauuggaaagaaggauggaaaacuugaauaaaaaaguugaugauggauuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaagguuaaacagggagaaaauugauggagugaaauuggaaucaaugggagucuaucagauucuggcgaucuacucaacagucgccaguucucugguucucuuggucucccugggggcaaucagcuucuggauguguuccaaugggucuuugcaguguagaauaugcaucuaa

SEQ ID NO: 36506 - RNA, 1698 nt, Artificial Sequence; identical to SEQ ID NO: 36443
  hemagglutinin__InfluenzaA__ADN89666

SEQ ID NO: 36507 - RNA, 1698 nt, Artificial Sequence; identical to SEQ ID NO: 36457
  hemagglutinin__InfluenzaA__ADN89677

SEQ ID NO: 36508 - RNA, 1698 nt, Artificial Sequence
  hemagglutinin__InfluenzaA__ADN89688
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacugcaauuggguaacugcagcguugccggguggaucuuaggaaacccagaaugcgaauuacugauuuccaaggagucauggucauacauuguagaaaaaccaaauccugagaauggaacauguuacccaggacauuucgcugacuaugaggaacugagggagcaauugaguucaguaucuucauuugagagguucgaaauauuccccaaagaaagcucauggcccaaccacaccguaaccggagugucagcaucaugcucccauaauggggaaaacaguuuuuacagaaauuugcuauggcugacggggaagaaugguuuguacccaaaccugagcaaguccuaugcaaacaacaaagaaaaagaaguccuuguacuaugggguguucaucacccgccaaacauggcugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucaaggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagagcuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36509 - RNA, 1698 nt, Artificial Sequence; identical to SEQ ID NO: 36444
  hemagglutinin__InfluenzaA__ADN89699

SEQ ID NO: 36510 - RNA, 1698 nt, Artificial Sequence; identical to SEQ ID NO: 36456
  hemagglutinin__InfluenzaA__ADN89710

SEQ ID NO: 36511 - RNA, 1698 nt, Artificial Sequence
  hemagglutinin__InfluenzaA__ADN89721
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcauugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaagcauaagugaccaaaagacccucuaucauacagaaaaugcuuauguuucuguagugucuucacauuauagcagaaaauucaccccagaaauagccaaaagaccuaaaguaagagaucaagaaggaagaaucaacuacuacuggacucugcuugaacccggggacacaauaauauuugaggcaaauggaaaccuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36512 - RNA, 1698 nt, Artificial Sequence; identical to SEQ ID NO: 36456
  hemagglutinin__InfluenzaA__ADN89732

SEQ ID NO: 36513 - RNA, 1698 nt, Artificial Sequence; identical to SEQ ID NO: 36456
  hemagglutinin__InfluenzaA__ADN89743

SEQ ID NO: 36514 - RNA, 1698 nt, Artificial Sequence; identical to SEQ ID NO: 36471
  hemagglutinin__InfluenzaA__ADN89765

SEQ ID NO: 36515 - RNA, 1698 nt, Artificial Sequence
  hemagglutinin__InfluenzaA__ADN89776
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaagcauaagugaucaaaagacccucuaucauacagaaaaugcuuauguuucuguagugucuucacauuauagcagaaaauucaccccagaaguagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagacgguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuga

SEQ ID NO: 36516 - RNA, 1698 nt, Artificial Sequence; identical to SEQ ID NO: 36457
  hemagglutinin__InfluenzaA__ADN89787

SEQ ID NO: 36517 - RNA, 1698 nt, Artificial Sequence
  hemagglutinin__InfluenzaA__ADN89798
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuauugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggagaagaaugguuuguacccgaaccugagcaaguccuaugcaaacaacaaagaaaaagaaguccuuguacuaugggguguucaucacccgccaagcauaagugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaacaaaaaaguugaugauggguuuauagacauuuggacauauaaugcagaacuguugguucuacuggaaaaugaaaggacuuuggauuuccaugacuccaaugugaagaaucuguaugagaaaguaaaaaaccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36518 - RNA, 1698 nt, Artificial Sequence
  hemagglutinin__InfluenzaA__ADN89809
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaagagucaugguccuacauuguagaaaagccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaguugaccaaaagacccucuaccguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggguaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36519 - RNA, 1698 nt, Artificial Sequence; identical to SEQ ID NO: 36518
  hemagglutinin__InfluenzaA__ADN89820

SEQ ID NO: 36520 - RNA, 1698 nt, Artificial Sequence; identical to SEQ ID NO: 36035
  hemagglutinin__InfluenzaA__ADN89831

SEQ ID NO: 36521 - RNA, 1698 nt, Artificial Sequence
  hemagglutinin__InfluenzaA__ADN89842
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacaggcacaauggaaaacuaugccuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaguugaccaaaagacccucuaucguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaaaugccaaacaccucagggagcuauaaacaguagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36522 - RNA, 1701 nt, Artificial Sequence; identical to SEQ ID NO: 36037
  hemagglutinin__InfluenzaA__ADN89864

SEQ ID NO: 36523 - RNA, 1701 nt, Artificial Sequence; identical to SEQ ID NO: 36037
  hemagglutinin__InfluenzaA__ADN89875

SEQ ID NO: 36524 - RNA, 1701 nt, Artificial Sequence
  hemagglutinin__InfluenzaA__ADN89886
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaaguggaaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaggaagcaacugagggaaaaugcugaggauaugggcaaugguuguuucacaauauaccacaaaugugacaaugccugcauaggaucaaucagaaauggaacuuaugaccacaauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 36525 - RNA, 1701 nt, Artificial Sequence; identical to SEQ ID NO: 36037
  hemagglutinin__InfluenzaA__ADN89897

SEQ ID NO: 36526 - RNA, 1701 nt, Artificial Sequence; identical to SEQ ID NO: 36037
  hemagglutinin__InfluenzaA__ADN89908

SEQ ID NO: 36527 - RNA, 1701 nt, Artificial Sequence
  hemagglutinin__InfluenzaA__ADN89919
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaaguggaaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcagagcuucuuguugcccuggagaaccaacauacaauugaucuaacugacucagaaaugaacaaacuguuugaaaaaacaaagaagcaacugagggaaaaugcugaggauaugggcaaugguuguuucacaauauaccacaaaugugacaaugccugcauaggaucaaucagaaauggaacuuaugaccacaauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 36528 - RNA, 1701 nt, Artificial Sequence; identical to SEQ ID NO: 36037
  hemagglutinin__InfluenzaA__ADN89930

SEQ ID NO: 36529 - RNA, 1701 nt, Artificial Sequence; identical to SEQ ID NO: 36037
  hemagglutinin__InfluenzaA__ADN89941

SEQ ID NO: 36530 - RNA, 1701 nt, Artificial Sequence; identical to SEQ ID NO: 36037
  hemagglutinin__InfluenzaA__ADN89952

SEQ ID NO: 36531 - RNA, 1701 nt, Artificial Sequence; identical to SEQ ID NO: 36037
  hemagglutinin__InfluenzaA__ADN89963

SEQ ID NO: 36532 - RNA, 1701 nt, Artificial Sequence
  hemagglutinin__InfluenzaA__ADN89974
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacaaaguggaaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucacaauauaccacaaaugugacaaugccugcauaggaucaaucagaaauggaacuuaugaccacaauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 36533 - RNA, 1701 nt, Artificial Sequence; identical to SEQ ID NO: 36037
  hemagglutinin__InfluenzaA__ADN89985

SEQ ID NO: 36534 - RNA, 1701 nt, Artificial Sequence; identical to SEQ ID NO: 36037
  hemagglutinin__InfluenzaA__ADN89996

SEQ ID NO: 36535 - RNA, 1701 nt, Artificial Sequence
  hemagglutinin__InfluenzaA__ADN90007
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaaguggaaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucacaauauaccacaaaugugacaaugccugcauaggaucaaucagaaauggaacuuaugaccacaauguauacagagaugaagcauuaaacaaccgguuccagaucaagggaguugagcugaagucaggguacaaggauuggauccuauggauuuccuuugccauaucauguuuuuugcuuuguguugcuuuguugggguucaucaugugggccugccaaaaaggcaacauuaggugcaacauuugcauuuga

SEQ ID NO: 36536 - RNA, 1701 nt, Artificial Sequence; identical to SEQ ID NO: 36037
  hemagglutinin__InfluenzaA__ADN90018

SEQ ID NO: 36537 - RNA, 1701 nt, Artificial Sequence; identical to SEQ ID NO: 36037
  hemagglutinin__InfluenzaA__ADN90040

SEQ ID NO: 36538 - RNA, 1701 nt, Artificial Sequence; identical to SEQ ID NO: 36037
  hemagglutinin__InfluenzaA__ADN90051

SEQ ID NO: 36539 - RNA, 1701 nt, Artificial Sequence; identical to SEQ ID NO: 36037
  hemagglutinin__InfluenzaA__ADN90062

SEQ ID NO: 36540 - RNA, 1701 nt, Artificial Sequence; identical to SEQ ID NO: 36037
  hemagglutinin__InfluenzaA__ADN90073

SEQ ID NO: 36541 - RNA, 1701 nt, Artificial Sequence
  hemagglutinin__InfluenzaA__ADN90084
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaaguggaaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauuuucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucacaauauaccacaaaugugacaaugccugcauaggaucaaucagaaauggaacuuaugaccacaauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 36542 - RNA, 1701 nt, Artificial Sequence; identical to SEQ ID NO: 36037
  hemagglutinin__InfluenzaA__ADN90095

SEQ ID NO: 36543 - RNA, 1701 nt, Artificial Sequence; identical to SEQ ID NO: 36037
  hemagglutinin__InfluenzaA__ADN90106

SEQ ID NO: 36544 - RNA, 1701 nt, Artificial Sequence; identical to SEQ ID NO: 36037
  hemagglutinin__InfluenzaA__ADN90117

SEQ ID NO: 36545 - RNA, 1701 nt, Artificial Sequence; identical to SEQ ID NO: 36037
  hemagglutinin__InfluenzaA__ADN90128

SEQ ID NO: 36546 - RNA, 1701 nt, Artificial Sequence; identical to SEQ ID NO: 36037
  hemagglutinin__InfluenzaA__ADN90139

SEQ ID NO: 36547 - RNA, 1701 nt, Artificial Sequence; identical to SEQ ID NO: 36037
  hemagglutinin__InfluenzaA__ADN90150

SEQ ID NO: 36548 - RNA, 1701 nt, Artificial Sequence
  hemagglutinin__InfluenzaA__ADN90161
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaagaagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaaguggaaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucacaauauaccacaaaugugacaaugccugcauaggaucaaucagaaauggaacuuaugaccacaauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 36549 - RNA, 1701 nt, Artificial Sequence; identical to SEQ ID NO: 36037
  hemagglutinin__InfluenzaA__ADN90172

SEQ ID NO: 36550 - RNA, 1701 nt, Artificial Sequence; identical to SEQ ID NO: 36037
  hemagglutinin__InfluenzaA__ADN90183

SEQ ID NO: 36551 - RNA, 1701 nt, Artificial Sequence; identical to SEQ ID NO: 36037
  hemagglutinin__InfluenzaA__ADN90194

SEQ ID NO: 36552 - RNA, 1701 nt, Artificial Sequence
  hemagglutinin__InfluenzaA__ADN90205
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacggggaaucuaauugcuccuagggguuacuucaaaauacgaaguggaaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucacaauauaccacaaaugugacaaugccugcauaggaucaaucagaaauggaacuuaugaccacaauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 36553 - RNA, 1701 nt, Artificial Sequence; identical to SEQ ID NO: 36037
  hemagglutinin__InfluenzaA__ADN90216

SEQ ID NO: 36554 - RNA, 1701 nt, Artificial Sequence
  hemagglutinin__InfluenzaA__ADN92467
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccauuuaaacuucaaauaccaagcauugaacgugacuaugccgaacaaugaacaauuugacaaauuguacauuugggggguucaccacccggguacggacaaagaccaaaucuuccuguaugcucaagcaucaggaagaaucacagucucuaccaaaagaagccaacaaacuguaaucccgaauaucggaucuagaccccgaguaaggaauaucccuagcagaauaagcaucuauuggacaauaguaaaaccgggagacauacuuuugauuaacagcacaggaaaucuaauugcuccuagggguuacuucaaaauacaaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugccuuguugggguucaucaugugggccugccaaaaaggcaacauuaggugcaacauuugcauuuga

SEQ ID NO: 36555 - RNA, 1701 nt, Artificial Sequence
  hemagglutinin__InfluenzaA__ADN92478
augaagacuaucauugcuuugagccacauucuaugucugguuuucgcucaaaaacuuccuggaaaugacaacagcacggcaacgcugugccuugggcaccaugcaguaccaaacggaacgauagugaaaacaaucacgaaugaccaaauugagguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauaccaagcauugaacgugacuaugccgaacaaugaacaauuugacaaauuguacauuugggggguucaccacccggguacggacaaagaccaaaucuuccuguaugcucaagcaucaggaagaaucacagucucuaccaaaagaagccaacaaacuguaaucccgaauaucggaucuagaccccgaguaaggaauaucccuagcagaauaagcaucuauuggacaauaguaaaaccgggagacauacuuuugauuaacagcacagggaaucuaauugcuccuagggguuacuucaaaauacaaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagagaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 36556 - RNA, 1701 nt, Artificial Sequence
  hemagglutinin__InfluenzaA__ADN92489
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugagguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaaacuucaauuggacuggagucacucaaaacggaacaagcucugcuugcauaaggagaucuaaaaacaguuucuuuaguagauugaauugguugacccacuuaaacuucaaauaccaagcauugaacgugacuaugccgaacaaugaacaauuugacaaauuguacauuugggggguucaccacccggguacggacaaagaccaaaucuuccuguaugcucaagcaucaggaagaaucacagucucuaccaaaagaagccaacaaacuguaaucccgaauaucggaucuagaccccgaguaaggaauaucccuagcagaauaagcaucuauuggacaauaguaaaaccgggagacauacuuuugauuaacagcacagggaaucuaauugcuccuagggguuacuucaaaauacaaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagagaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 36557 - RNA, 1701 nt, Artificial Sequence
  hemagglutinin__InfluenzaA__ADN92500
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugagguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauaccaagcauugaacgugacuaugccgaacaaugaacaauuugacaaauuguacauuugggggguucaccacccggguacggacaaagaccaaaucuuccuguaugcucaagcaucaggaagaaucacagucucuaccaaaagaagccaacaaacuguaaucccgaauaucggaucuagaccccgaguaaggaauaucccuagcagaauaagcaucuauuggacaauaguaaaaccgggagacauacuuuugauuaacagcacagggaaucuaauugcuccuagggguuacuucaaaauacaaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagagaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 36558 - RNA, 1701 nt, Artificial Sequence; identical to SEQ ID NO: 34537
  hemagglutinin__InfluenzaA__ADN92510

SEQ ID NO: 36559 - RNA, 1701 nt, Artificial Sequence; identical to SEQ ID NO: 34537
  hemagglutinin__InfluenzaA__ADN92520

SEQ ID NO: 36560 - RNA, 1701 nt, Artificial Sequence
  hemagglutinin__InfluenzaA__ADN92530
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucaggcaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguaucaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggauguguucuaaugggucucuacaguguagaauauguauuuaa

SEQ ID NO: 36561 - RNA, 1701 nt, Artificial Sequence
  hemagglutinin__InfluenzaA__ADN92540
auggaggcaauacuaguaguucuacuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaaggggguuggacagggaugguggauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36562 - RNA, 1701 nt, Artificial Sequence
  hemagglutinin__InfluenzaA__ADN92550
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugcagaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36563 - RNA, 1701 nt, Artificial Sequence; identical to SEQ ID NO: 34537
  hemagglutinin__InfluenzaA__ADN92560

SEQ ID NO: 36564 - RNA, 1701 nt, Artificial Sequence
  hemagglutinin__InfluenzaA__ADO00730
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagaguguggaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgggauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36565 - RNA, 1701 nt, Artificial Sequence
  hemagglutinin__InfluenzaA__ADO00740
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggaauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuaguggugccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36566 - RNA, 1701 nt, Artificial Sequence
  hemagglutinin__InfluenzaA__ADO00750
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccuaggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuauauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaucuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggauguguucuaaugggucucuacaguguagaauauguauuuaa

SEQ ID NO: 36567 - RNA, 1701 nt, Artificial Sequence; identical to SEQ ID NO: 33173
  hemagglutinin__InfluenzaA__ADO12143

SEQ ID NO: 36568 - RNA, 1701 nt, Artificial Sequence; identical to SEQ ID NO: 33173
  hemagglutinin__InfluenzaA__ADO12153

SEQ ID NO: 36569 - RNA, 1701 nt, Artificial Sequence; identical to SEQ ID NO: 33173
  hemagglutinin__InfluenzaA__ADO12163

SEQ ID NO: 36570 - RNA, 1701 nt, Artificial Sequence; identical to SEQ ID NO: 33173
  hemagglutinin__InfluenzaA__ADO12173

SEQ ID NO: 36571 - RNA, 1701 nt, Artificial Sequence; identical to SEQ ID NO: 33173
  hemagglutinin__InfluenzaA__ADO12183

SEQ ID NO: 36572 - RNA, 1701 nt, Artificial Sequence; identical to SEQ ID NO: 33173
  hemagglutinin__InfluenzaA__ADO12193

SEQ ID NO: 36573 - RNA, 1701 nt, Artificial Sequence; identical to SEQ ID NO: 33173
  hemagglutinin__InfluenzaA__ADO12203

SEQ ID NO: 36574 - RNA, 1701 nt, Artificial Sequence; identical to SEQ ID NO: 33173
  hemagglutinin__InfluenzaA__ADO12213

SEQ ID NO: 36575 - RNA, 1701 nt, Artificial Sequence; identical to SEQ ID NO: 33173
  hemagglutinin__InfluenzaA__ADO12223

SEQ ID NO: 36576 - RNA, 1701 nt, Artificial Sequence; identical to SEQ ID NO: 33173
  hemagglutinin__InfluenzaA__ADO12233

SEQ ID NO: 36577 - RNA, 1701 nt, Artificial Sequence
  hemagglutinin__InfluenzaA__ADO12243
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggagaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36578 - RNA, 1701 nt, Artificial Sequence; identical to SEQ ID NO: 33173
  hemagglutinin__InfluenzaA__ADO12253

SEQ ID NO: 36579 - RNA, 1701 nt, Artificial Sequence; identical to SEQ ID NO: 33173
  hemagglutinin__InfluenzaA__ADO12263

SEQ ID NO: 36580 - RNA, 1701 nt, Artificial Sequence; identical to SEQ ID NO: 33173
  hemagglutinin__InfluenzaA__ADO12273

SEQ ID NO: 36581 - RNA, 1701 nt, Artificial Sequence
  hemagglutinin__InfluenzaA__ADO12283
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgaaauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36582 - RNA, 1701 nt, Artificial Sequence; identical to SEQ ID NO: 33173
  hemagglutinin__InfluenzaA__ADO12293

SEQ ID NO: 36583 - RNA, 1701 nt, Artificial Sequence; identical to SEQ ID NO: 33173
  hemagglutinin__InfluenzaA__ADO12303

SEQ ID NO: 36584 - RNA, 1701 nt, Artificial Sequence; identical to SEQ ID NO: 33173
  hemagglutinin__InfluenzaA__ADO12313

SEQ ID NO: 36585 - RNA, 1701 nt, Artificial Sequence; identical to SEQ ID NO: 36577
  hemagglutinin__InfluenzaA__ADO12323

SEQ ID NO: 36586 - RNA, 1701 nt, Artificial Sequence
  hemagglutinin__InfluenzaA__ADO12333
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagcugaccugaagagcacacagaaugccauugacgagauuacuaacaaagugaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36587 - RNA, 1701 nt, Artificial Sequence; identical to SEQ ID NO: 33173
  hemagglutinin__InfluenzaA__ADO12343

SEQ ID NO: 36588 - RNA, 1701 nt, Artificial Sequence; identical to SEQ ID NO: 33173
  hemagglutinin__InfluenzaA__ADO12353

SEQ ID NO: 36589 - RNA, 1701 nt, Artificial Sequence; identical to SEQ ID NO: 36586
  hemagglutinin__InfluenzaA__ADO12363

SEQ ID NO: 36590 - RNA, 1701 nt, Artificial Sequence
  hemagglutinin__InfluenzaA__ADO12373
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaauaauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36591 - RNA, 1701 nt, Artificial Sequence; identical to SEQ ID NO: 34658
  hemagglutinin__InfluenzaA__ADO12383

SEQ ID NO: 36592 - RNA, 1701 nt, Artificial Sequence
  hemagglutinin__InfluenzaA__ADO12403
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauguacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36593 - RNA, 1701 nt, Artificial Sequence
  hemagglutinin__InfluenzaA__ADO12413
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugagaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36594 - RNA, 1701 nt, Artificial Sequence; identical to SEQ ID NO: 33173
  hemagglutinin__InfluenzaA__ADO12423

SEQ ID NO: 36595 - RNA, 1701 nt, Artificial Sequence; identical to SEQ ID NO: 33173
  hemagglutinin__InfluenzaA__ADO12433

SEQ ID NO: 36596 - RNA, 1701 nt, Artificial Sequence; identical to SEQ ID NO: 33173
  hemagglutinin__InfluenzaA__ADO12443

SEQ ID NO: 36597 - RNA, 1701 nt, Artificial Sequence; identical to SEQ ID NO: 33173
  hemagglutinin__InfluenzaA__ADO12453

SEQ ID NO: 36598 - RNA, 1701 nt, Artificial Sequence; identical to SEQ ID NO: 33173
  hemagglutinin__InfluenzaA__ADO12463

SEQ ID NO: 36599 - RNA, 1701 nt, Artificial Sequence
  hemagglutinin__InfluenzaA__ADO12473
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcaaaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36600 - RNA, 1701 nt, Artificial Sequence; identical to SEQ ID NO: 33173
  hemagglutinin__InfluenzaA__ADO12493

SEQ ID NO: 36601 - RNA, 1701 nt, Artificial Sequence
  hemagglutinin__InfluenzaA__ADO12503
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaacgucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaauuucuggaugugcucuaaugggucucuacaguguagaauauguauuuaa

SEQ ID NO: 36602 - RNA, 1701 nt, Artificial Sequence
  hemagglutinin__InfluenzaA__ADO12513
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagagguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacaagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36603 - RNA, 1701 nt, Artificial Sequence; identical to SEQ ID NO: 33173
  hemagglutinin__InfluenzaA__ADO12523

SEQ ID NO: 36604 - RNA, 1701 nt, Artificial Sequence
  hemagglutinin__InfluenzaA__ADO12533
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaagauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36605 - RNA, 1701 nt, Artificial Sequence; identical to SEQ ID NO: 33173
  hemagglutinin__InfluenzaA__ADO12543

SEQ ID NO: 36606 - RNA, 1701 nt, Artificial Sequence; identical to SEQ ID NO: 33173
  hemagglutinin__InfluenzaA__ADO12553

SEQ ID NO: 36607 - RNA, 1701 nt, Artificial Sequence; identical to SEQ ID NO: 36388
  hemagglutinin__InfluenzaA__ADO12563

SEQ ID NO: 36608 - RNA, 1701 nt, Artificial Sequence; identical to SEQ ID NO: 33173
  hemagglutinin__InfluenzaA__ADO12573

SEQ ID NO: 36609 - RNA, 1701 nt, Artificial Sequence
  hemagglutinin__InfluenzaA__ADO12593
augaaggcaauacuaguaguucugcuauauacauuugcaaccgcaaaugcagacacauuauguauagguuaucaugcgaacaauucaacagacauuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36610 - RNA, 1701 nt, Artificial Sequence
  hemagglutinin__InfluenzaA__ADO12603
augaaggcaauacuaguaguucugcuauauacauuugcaaccgcaaaugcagacacauuauguauagguuaucaugcgaacaauucaacagacacuguagacacaguacuagaaaagaauguaacaguaacacacucugucaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36611 - RNA, 1701 nt, Artificial Sequence
  hemagglutinin__InfluenzaA__ADO12613
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaauuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauacgaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36612 - RNA, 1701 nt, Artificial Sequence
  hemagglutinin__InfluenzaA__ADO12623
augaaggcaauacuaguaguucugcuauauacauuugcaaccgcaaaugcagacacauuauguauagguuaucaugcgaacaauucaacagacacuguagacacaguacuagaaaagaauguaacaguaacacauucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36613 - RNA, 1701 nt, Artificial Sequence
  hemagglutinin__InfluenzaA__ADO14349
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaaagggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaaaggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccuagugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauaugugaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36614 - RNA, 1701 nt, Artificial Sequence
  hemagglutinin__InfluenzaA__ADO14351
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggagauagcaauaagacccaaagugaggggucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuugccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36615 - RNA, 1701 nt, Artificial Sequence
  hemagglutinin__InfluenzaA__ADO14353
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcugaagcaaaaagcuucuacaaaaauuuaauauggcuaguuaaaaaaggaaauucauacccaaagcucagcaaauccuacauuaaugauaaagggaaagaaguccuagugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaucaucaaaaugagcaggggucaggauaugcagccgaccugaagagcacacagaaugccauugacgagauuacuaacaaagugaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36616 - RNA, 1701 nt, Artificial Sequence
  hemagglutinin__InfluenzaA__ADO14354
augaaggcaauacuaguaguucugcuauauacauuugcaaccgcuaaugcagacacauuauguauggguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagaaaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36617 - RNA, 1701 nt, Artificial Sequence
  hemagglutinin__InfluenzaA__ADO14356
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugaggggucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccagaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36618 - RNA, 1701 nt, Artificial Sequence
  hemagglutinin__InfluenzaA__ADO14357
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccuaguacuauggggcauucaccauccaucuacuagugcugaccaacaaagucucuaucagaaugcagaugcauauguuuuuguggggacaucaagauacagcaagaaguucaagccggaaauagcaauaagacccaaagugaggggucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauaugugaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36619 - RNA, 1701 nt, Artificial Sequence
  hemagglutinin__InfluenzaA__ADO14359
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaccuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36620 - RNA, 1701 nt, Artificial Sequence
  hemagglutinin__InfluenzaA__ADO14361
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaaaggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccuagugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauaugugaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36621 - RNA, 1701 nt, Artificial Sequence
  hemagglutinin__InfluenzaA__ADO14362
augaaggcaauacuaguaguucugcuauauacauuugcaaccgcaaaugcagacacauuauguauagguuaucaugcgaacaauucaacagacacuguagacacaguauuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaaugggacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaguccuacauuaaugauaaagggaaagaaguccucgugcuauggggcauucaccauccaucuaauagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaguguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaacgggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36622 - RNA, 1683 nt, Artificial Sequence
  hemagglutinin__InfluenzaA__ADO21015
auggaaguaguaucacuaauaacuauacuacuauuaguaacaguaagcaaugcagauaaaaucugcaucggcuaccaaucaacaaacuccacagaaacuguagacacgcuaacagaaaacaauguuccuguggcacaugccaaagaauugcuccacacagagcacaaugggaugcuuugugcaacaaaucugggacauccucuuauucuagacaccuguaccauugaaggacuaaucuauggcaacccuucuugugaucuacuguugggaggaagagaaugguccuacaucgucgaaagaccaucggcuguuaauggauuguguuaccccgggaauguagaaaaccuagaagaacuacggucacuuuuuaguucugcuaguucuuaccaaagaauccagaucuuuccaggcacaaucuggaaugugucuuacggugggacaagcaaagcauguucagauucauucuacaaaagcaugagaugguugacucaaaagaacaacgcuuacccuauucaagacgcccaauacacaaauaauagagggaagaacauucuuuucauguggggcauaaaucacccacccaccgauacuacgcagacaaaucuguacacaaggacugacacaacaacaaguguggcaacagaagauauaaauaggaccuucaaaccauugauagggccaaggccucuugucaauggucagcagggaagaauugauuauuauuggucgguauugaaaccaggucagacauugcgaguaagauccaaugggaaucuaaucgcuccaugguauggacacauucuuucaggagagagccacggaagaauccugaagacugauuugaacagugguaacuguguugugcaaugucagacagaaagagguggcuuaaauacuacauugccauuccacaauguaaguaaguaugcauuugggaacugcccaaaauauguuggaguaaagagucucaaauuggcaguuggucugaggaaugugccugcuagaucaaguagaggacuauucggggccauagcuggauucauagagggagguuggucagggcuagucgcugguugguauggguuccagcauucaaaugaucaagggguugguauggcagcagauagagacucaacucaaaaggcaauugacaaaauaacauccaaagugaauaauauagucgauaaaaugaacaaacaguaugaaauuauugaucaugaauucagcgagguugaaacuagacucaacaugaucaauaauaagauugaugaccaaauucaagacauaugggcauauaacgcagaauugcuagugcugcuugaaaaccagaaaacacucgaugagcaugaugcgaauguaaacaaucuauacaauaaagugaagagggcauuggguuccaaugcaguggaagaugggaaaggauguuucgagcuauaccauaaaugugaugaccagugcauggagacaauucggaacgggaccuacaacaggagaaaguauaaagaggaaucaagacuagaaagacagaaaauagaaggggucaagcuggaaucugaaggaacuuacaaaauccucaccauuuauucgacugucgccucaucucuugugauugcaaugggguuugcugccuucuuguucugggccauguccaauggaucuugcagaugcaacauuuguauauaa

SEQ ID NO: 36623 - RNA, 1683 nt, Artificial Sequence
  hemagglutinin__InfluenzaA__ADO21026
auggaaguaguaucacuaauaacuauacuacuauuaguaacaguaagcaaugcagauaaaaucugcaucggcuaccaaucaacaaacuccacagaaacuguagacacgcuaacagaaaacaauguuccuguggcacaugccaaagaauugcuccacacagagcacaaugggaugcuuugugcaacaaaucugggacauccucuuauucuagacaccuguaccauugaaggacuaaucuauggcaacccuucuugugaucuacuguugggaggaagagaaugguccuacaucgucgaaagaccaucggcuguuaauggauuguguuaccccgggaauguagaaaaccuagaagaacuacggucacuuuuuaguucugcuaguucuuaccaaagaauccagaucuuuccaggcacaaucuggaaugugucuuacggugggacaagcaaagcauguucagauucauucuacaaaagcaugagaugguugacucaaaagaacaacgcuuacccuauucaagacgcccaauacacaaauaauagagggaagaacauucuuuucauguggggcauaaaucacccacccaccgauacuacgcagacaaaucuguacacaaggacugacacaacaacaaguguggcaacagaagauauaaauaggaccuucaauccauugauagggccaaggccucuugucaauggucagcagggaagaauugauuauuauuggucgguauugaaaccaggucagacauugcgaguaagauccaaugggaaucuaaucgcuccaugguauggacacauucuuucaggagagagccacggaagaauccugaagacugauuugaacagugguaacuguguugugcaaugucagacagaaagagguggcuuaaauacuacauugccauuccacaauguaaguaaguaugcauuugggaacugcccaaaauauguuggaguaaagagucucaaauuggcaguuggucugaggaaugugccugcuagaucaaguagaggacuauucggggccauagcuggauucauagagggagguuggucagggcuagucgcugguugguauggguuccagcauucaaaugaucaagggguugguauggcagcagauagagacucaacucaaaaggcaauugacaaaauaacauccaaagugaauaauauagucgauaaaaugaacaaacaguaugaaauuauugaucaugaauucagcgagguugaaacuagacucaacaucaucaauaauaagauugaugaccaaauucaagacauaugggcauauaacgcagaauugcuagugcugcuugaaaaccagaaaacacucgaugagcaugaugcgaauguaaacaaucuauacaauaaagugaagagggcauuggguuccaaugcaguggaagaugggaaaggauguuucgagcuauaccauaaaugugaugaccagugcauggagacaauucggaacgggaccuacaacaggagaaaguauaaagaggaaucaagacuagaaagacagaaaauagaaggggucaagcuggaaucugaaggaacuuacaaaauccucaccauuuauucgacugucgccucaucucuugugauugcaaugggguuugcugccuucuuguucugggccauguccaauggaucuugcagaugcaacauuuguauauaa

SEQ ID NO: 36624 - RNA, 1683 nt, Artificial Sequence
  hemagglutinin__InfluenzaA__ADO21037
auggaaguaguaucacuaauaacuauacuacuauuaguaacaguaagcaaugcagauaaaaucugcaucggcuaccaaucaacaaacuccacagaaacuguagacacgcuaacagaaaacaauguuccuguggcacaugccaaagaauugcuccacacagagcacaaugggaugcuuugugcaacaaaucugggacauccucuuauucuagacaccuguaccauugaaggacuaaucuauggcaacccuucuugugaucuacuguugggaggaagagaaugguccuacaucgucgaaagaccaucggcuguuaauggauuguguuaccccgggaauguagaaaaccuagaagaacuacggucacuuuuuaguucugcuaguucuuaccaaagaauccagaucuuuccaggcacaaucuggaaugugucuuacggugggacaagcaaagcauguucagauucauucuacaaaagcaugagaugguugacucaaaagaacaacgcuuacccuauucaagacgcccaauacacaaauaauagagggaagaacauucuuuucauguggggcauaaaucacccacccaccgauacuacgcagacaaaucuguacacaaggacugacacaacaacaaguguggcaacagaagauauaaauaggaccuucaaaccauacauagggccaaggccucuugucaauggucagcagggaagaauugauuauuauuggucgguauugaaaccaggucagacauugcgaguaagauccaaugggaaucuaaucgcuccaugguauggacacauucuuucaggagagagccacggaagaauccugaagacugauuugaacagugguaacuguguugugcaaugucagacagaaagagguggcuuaaauacuacauugccauuccacaauguaaguaaguaugcauuugggaacugcccaaaauauguuggaguaaagagucucaaauuggcaguuggucugaggaaugugccugcuagaucaaguagaggacuauucggggccauagcuggauucauagagggagguuggucagggcuagucgcugguugguauggguuccagcauucaaaugaucaagggguugguauggcagcagauagagacuuaacucaaaaggcaauugacaaaauaacauccaaagugaauaauauagucgauaaaaugaacaaacaguaugaaauuauugaucaugaauucagcgagguugaaacuagacucaacaugaucaauaauaagauugaugaccaaauucaagacauaugggcauauaacgcagaauugcuagugcugcuugaaaaccagaaaacacucgaugagcaugaugcgaauguaaacaaucuauacaauaaagugaagagggcauuggguuccaaugcaguggaagaugggaaaggauguuucgagcuauaccauaaaugugaugaccagugcauggagacaauucggaacgggaccuacaacaggagaaaguauaaagaggaaucaagacuagaaagacagaaaauagaaggggucaagcuggaaucugaaggaacuuacaaaauccucaccauuuauucgacugucgccucaucucuugugauugcaaugggguuugcugccuucuuguucugggccauguccaauggaucuugcagaugcaacauuuguauauaa

SEQ ID NO: 36625 - RNA, 1683 nt, Artificial Sequence
  hemagglutinin__InfluenzaA__ADO21048
auggaaguaguaucacuaauaacuauacuacuauuaguaacaguaagcaaugcagauaaaaucugcaucggcuaccaaucaacaaacuccacagaaacuguagacacgcuaacagaaaacaauguuccuguggcacaugccaaagaauugcuccacacagagcacaaugggaugcuuugugcaacaaaucugggacauccucuuauucuagacaccuguaccauugaaggacuaaucuauggcaacccuucuugugaucuacuguugggaggaagagaaugguccuacaucgucgaaagaccaucggcuguuaauggauuguguuaccccgggaauguagaaaaccuagaagaacuacggucacuuuuuaguucugcuaguucuuaccaaagaauccagaucuuuccaggcacaaucuggaaugugucuuacggugggacaagcaaagcauguucagauucauucuacaaaagcaugagaugguugacucaaaagaacaacgcuuacccuauucaagacgcccaauacacaaauaauagagggaagaacauucauuucauguggggcauaaaucacccacccaccgauacuacgcagacaaaucuguacacaaggacugacacaacaacaaguguggcaacagaagauauaaauaggaccuucaaaccauugauagggccaaggccucuugucaauggucagcagggaagaauugauuauuauuggucgguauugaaaccaggucagacauugcgaguaagauccaaugggaaucuaaucgcuccaugguauggacacauucuuucaggagagagccacggaagaauccugaagacugauuugaacagugguaacuguguugugcaaugucagacagaaagagguggcuuaaauacuacauugccauuccacaauguaaguaaguaugcauuugggaacugcccaaaauauguuggaguaaagagucucaaauuggcaguuggucugaggaaugugccugcuagaucaaguagaggacuauucggggccauagcuggauucauagagggagguuggucagggcuagucgcugguugguauggguuccagcauucaaaugaucaagggguugguauggcagcagauagagucucaacucaaaaggcaauugacaaaauaacauccaaagugaauaauauagucgauaaaaugaacaaacaguaugaaauuauugaucaugaauucagcgagguugaaacuagacucaacaugaucaauaauaagauugaugaccaaauucaagacauaugggcauauaacgcagaauugcuagugcugcuugaaaaccagaaaacacucgaugagcaugaugcgaauguaaacaaucuauacaauaaagugaagagggcauuggguuccaaugcaguggaagaugggaaaggauguuucgagcuauaccauaaaugugaugaccagugcauggagacaauucggaacgggaccuacaacaggagaaaguauaaagaggaaucaagacuagaaagacagaaaauagaaggggucaagcuggaaucugaaggaacuuacaaaauccucaccauuuauucgacugucgccucaucucuugugauugcaaugggguuugcugccuucuuguucugggccauguccaauggaucuugcagaugcaacauuuguauauaa

SEQ ID NO: 36626 - RNA, 1701 nt, Artificial Sequence
  hemagglutinin__InfluenzaA__ADO25092
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccuggggaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaacuccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccagcccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36627 - RNA, 1701 nt, Artificial Sequence
  hemagglutinin__InfluenzaA__ADO25112
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaguccuacauuaaugauaaagggaaagaaguccucgugcuauggggcauucaccauccaucuacuaguacugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36628 - RNA, 1701 nt, Artificial Sequence; identical to SEQ ID NO: 36627
  hemagglutinin__InfluenzaA__ADO25122

SEQ ID NO: 36629 - RNA, 1701 nt, Artificial Sequence
  hemagglutinin__InfluenzaA__ADO25132
augaaugcaauacuaguaguucugcuauauacauuugcaaccgcaaaugcagacacauuauguauagguuaucaugcgaacaauucaacagacacuguagacacauuacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugauauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaauaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36630 - RNA, 1701 nt, Artificial Sequence; identical to SEQ ID NO: 35990
  hemagglutinin__InfluenzaA__ADO25142

SEQ ID NO: 36631 - RNA, 1701 nt, Artificial Sequence
  hemagglutinin__InfluenzaA__ADO25152
augaaggcaauacuaguaguucugcuauauacauuugcagccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucauuauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaaccuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36632 - RNA, 1701 nt, Artificial Sequence
  hemagglutinin__InfluenzaA__ADO25162
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagaaccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36633 - RNA, 1701 nt, Artificial Sequence; identical to SEQ ID NO: 34731
  hemagglutinin__InfluenzaA__ADO25172

SEQ ID NO: 36634 - RNA, 1701 nt, Artificial Sequence; identical to SEQ ID NO: 34731
  hemagglutinin__InfluenzaA__ADO25182

SEQ ID NO: 36635 - RNA, 1701 nt, Artificial Sequence; identical to SEQ ID NO: 35349
  hemagglutinin__InfluenzaA__ADO25192

SEQ ID NO: 36636 - RNA, 1701 nt, Artificial Sequence
  hemagglutinin__InfluenzaA__ADO25202
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcugagagagcaauugagcucagugucaucauuugaaagguuugagauauuccccaagacaaguucauggcccaaucaugacucaaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucuauaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36637 - RNA, 1701 nt, Artificial Sequence
  hemagglutinin__InfluenzaA__ADO25212
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagauuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacaucaaugauaaaaggaaagaaguccucgugcuauggggcauucaccauccaucuacuagugcugaccaacaaagucucuaucagaaugcagauucauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36638 - RNA, 1701 nt, Artificial Sequence
  hemagglutinin__InfluenzaA__ADO25222
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugaaauauuccccaagacaaguucauggcccaaucaugacucgaacaaagguguaacggcagcauguccucaugcuggagcaaagagcuucuauaaaaauuuaauauggcuaguuaaaaaaggaaauucauacccaaagcucaacaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguucacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36639 - RNA, 1701 nt, Artificial Sequence; identical to SEQ ID NO: 35990
  hemagglutinin__InfluenzaA__ADO25232

SEQ ID NO: 36640 - RNA, 1701 nt, Artificial Sequence; identical to SEQ ID NO: 36632
  hemagglutinin__InfluenzaA__ADO25242

SEQ ID NO: 36641 - RNA, 1701 nt, Artificial Sequence
  hemagglutinin__InfluenzaA__ADO25252
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcugguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacgguugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugauagucucccugggggcaaucaguuucuggaugugcucuaaugggucucuacaguguagaauauguauuuaa

SEQ ID NO: 36642 - RNA, 1701 nt, Artificial Sequence
  hemagglutinin__InfluenzaA__ADO25262
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaguccuacauuaaugauaaagggaaagaaguccucgugcuauggggcauucaccauccaucuacuaguacugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaaaaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36643 - RNA, 1701 nt, Artificial Sequence
  hemagglutinin__InfluenzaA__ADO25272
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauguuucccaagacaaguucauggcccaaucaugacucgaacaaagguguaacggcagcauguccucaugcuggaguaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuaguggugccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36644 - RNA, 1701 nt, Artificial Sequence; identical to SEQ ID NO: 35990
  hemagglutinin__InfluenzaA__ADO25282

SEQ ID NO: 36645 - RNA, 1698 nt, Artificial Sequence; identical to SEQ ID NO: 33009
  hemagglutinin__InfluenzaA__ADO27622

SEQ ID NO: 36646 - RNA, 1701 nt, Artificial Sequence
  hemagglutinin__InfluenzaA__ADO29887
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccaucgacgagauuacuaacaaaguaaauucugucauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggauguguucuaaugggucucuacaguguagaauauguauuuaa

SEQ ID NO: 36647 - RNA, 1701 nt, Artificial Sequence
  hemagglutinin__InfluenzaA__ADO29888
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcagacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36648 - RNA, 1701 nt, Artificial Sequence
  hemagglutinin__InfluenzaA__ADO29889
augaaggcaauacuaguaguucugcuauauacauuugcaaccgcaaaugcagacauauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucuuucuccacaucaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaacauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaucaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36649 - RNA, 1701 nt, Artificial Sequence
  hemagglutinin__InfluenzaA__ADO29890
augaaggcaauacuaguaguucugcuauauacauuugcaaccgcaaaggcagacacauuauguauagguuaucaugcgaacaauucagcagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacgaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuaguguugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaacgccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccaugauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagauggaguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36650 - RNA, 1701 nt, Artificial Sequence
  hemagglutinin__InfluenzaA__ADO29891
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaaggaagaaugaacuauuacuggacacuaguagagccgggagacaaaacaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuaucggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36651 - RNA, 1701 nt, Artificial Sequence
  hemagglutinin__InfluenzaA__ADO29892
augaaggcaauacuaguaguucugcuauauacauuugcaaccgcaaaggcagacacauuauguauagguuaucaugcgaacaauucaacagacacuguagacacaguacuagaaaagaauguaacaguaacacacucuguuaaccuucuagaagacaagcauaacgggaagcuaugcaaacuaagagggguagccccauugcauuuggguaaauguaacauugcuggccggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauccaccauccaucuacuaguguugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauugguaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccaugauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagauggaguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36652 - RNA, 1701 nt, Artificial Sequence
  hemagglutinin__InfluenzaA__ADO29893
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucguggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuguuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacuaguagucucccugggggcaaucaguuuuuggaugugcucuaaugggucucuacaguguagaauauguauuuaa

SEQ ID NO: 36653 - RNA, 1701 nt, Artificial Sequence
  hemagglutinin__InfluenzaA__ADO29894
augaaggcaauacuaguaguucugcuauauacauuugcaaccgcaaaugcagacacauuauguauagguuaucaugcgaacaauucaacagacacuguagacacaguacuagaaaugaauguaacaguaacacacucuguuaaccuucuagaagacaagcauaacgggaaacuaugcaaacuaagagggguagccccauugcauuuggguaaauguaacauugcuggcuggauccugggaaauccagagugugaaucauucuccacaucaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaguucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauuaagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaggcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36654 - RNA, 1701 nt, Artificial Sequence
  hemagglutinin__InfluenzaA__ADO29895
augaaggcaauacuaguagcucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucauucuccacaucaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaguucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaggcacaaaauuaagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaacgugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36655 - RNA, 1701 nt, Artificial Sequence
  hemagglutinin__InfluenzaA__ADO29897
augaaggcaauacuaguaguucugcuauauacauuugcaaccgcaaaugcagacauauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucuuucuccacaucaagcucaugguccuacauuguggaaacaucuaguucagacaauggaaaguguuacccaggagauuucaucgauuaugaggagcuaagagagcaauugagcucagugucaucauuugaaagguuugagauauuccccaagacaaguucauggcccaaucaugacucgaacaaagguguaacgacagcauguccucaugcuggagcaaaaagcuucuacaaaaauuuaauauggcuaguuaaaaaaggaaauucauacccaaggcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgguugcaauacaacuugucagacacccaagggugcuauaaacaccagccucccauuucagaacauacauccgaucacaauuggaaaauguccaaaauauguaaaaagcacaaaauugagacuggccacaggauugaggaaugucccgucuauucaaucuagaggccuauuuggggccguugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaucaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuauccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36656 - RNA, 1701 nt, Artificial Sequence
  hemagglutinin__InfluenzaA__ADO29898
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaagcucauggcccaaucaugacccgaacaaagguguaacggcagcauguccucaugcuggagcaaaaagcuucuacaaaaauuuaauauggcuaguuaaaaaaggaaauucguacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36657 - RNA, 1701 nt, Artificial Sequence
  hemagglutinin__InfluenzaA__ADO29899
augaaggcaauacuaguaguucugcuauauacauuugcaaccgcaaaugcagacacauuaugcauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcgaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagacgcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaacauguauuuaa

SEQ ID NO: 36658 - RNA, 1701 nt, Artificial Sequence
  hemagglutinin__InfluenzaA__ADO29900
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagaucucaucgauuaugaggagcuaagagagcaauugagcucagugucaucauuugaaagguuugagauauuccccaagacaaguucauggcccaaucaugaccugaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguccaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaagaagcacaaaauugagacuggccacaggguugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugacgguuuccuggacauuugggcuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36659 - RNA, 1701 nt, Artificial Sequence
  hemagglutinin__InfluenzaA__ADO29901
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgagaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuagcuaaaaaaggaaauucauacccaaaggucagcaaauccuacauuaaugauaaagggaaagagguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguugagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggauguguuuuaaugggucucuacaguguagaauauguauuuaa

SEQ ID NO: 36660 - RNA, 1701 nt, Artificial Sequence
  hemagglutinin__InfluenzaA__ADO29902
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugagucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucacgacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugccgaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaggugucaaaaaugggacuuaugacuacccaaaauacucagaggaagcgaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36661 - RNA, 1701 nt, Artificial Sequence
  hemagglutinin__InfluenzaA__ADO29903
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacacugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36662 - RNA, 1701 nt, Artificial Sequence
  hemagglutinin__InfluenzaA__ADO29904
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguagauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccguccaucuacuagugcugaccaacaaagucucuaucagaaugcagaugcauauguuuuuguggggacaucaagauacagcaagaaguucaagccggaaauagcaauaagacccaaagugggggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucaaauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucuggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauauggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36663 - RNA, 1701 nt, Artificial Sequence
  hemagglutinin__InfluenzaA__ADO29905
augaaggcaauacuaguaguucugcuauauacauuugcaaccgcaaaugcagacacauuauguauagguuaucaugcgaacaauucaacagacacuguagacacaguacuagaaaagaauguaacaguaacacgcucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccacccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucaaauacaccgguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucuggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauauggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36664 - RNA, 1701 nt, Artificial Sequence
  hemagglutinin__InfluenzaA__ADO29906
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacaggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuaccaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugauuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36665 - RNA, 1701 nt, Artificial Sequence
  hemagglutinin__InfluenzaA__ADO29907
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcacaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaagcucaagccggaaauagcaauaagacccaaagugagggaucaagaagggagaaugaacuaucacuggacacuaguagagccgggggacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggacugaggaaugucccgucuauucaaucuagaggccuauuuggggccauugccgguuucauugaagggggguggacaggaaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36666 - RNA, 1701 nt, Artificial Sequence
  hemagglutinin__InfluenzaA__ADO29908
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaauggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuccagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauauggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggguuuaccagauuuuggcgaccuauucaacugucgccaguucauugguacugguagucucccugggggcaaucaguuucuggaugugcucuaaugggucucuacaguguagaauauguauuuaa

SEQ ID NO: 36667 - RNA, 1701 nt, Artificial Sequence
  hemagglutinin__InfluenzaA__ADO29909
augaaggcaauacuaguaguucugcuauauacauuugcaaccgcaaaugcagacacauuacguauagguuaucaugcgaacaauucaacagacacuguagacacaguacuagaaaagaauguaacaguaacacauucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggaguuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaacgcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcauacagaaugccauugacgagauuacuaacaaaguaaauucugucauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccgaaauacucagaggaagcaaaauuaaacagagaagaaauagaugggguaaagcuggaaucaacaaggauuuaccagauuuuggcgaucuauucaacugucgccaguucauugauacugguagucucccugggggcaaucaguuucuggaugugcucuaaugggucuuuacaguguagaauauguauuuaa

SEQ ID NO: 36668 - RNA, 1701 nt, Artificial Sequence
  hemagglutinin__InfluenzaA__ADO29910
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaaccaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccgucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaauuggaaaucuagugguaccgagauaugcauucgcaauggaaaggaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugaacaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagaggagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36669 - RNA, 1701 nt, Artificial Sequence
  hemagglutinin__InfluenzaA__ADO30407
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucauuauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucagaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaacgaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36670 - RNA, 1701 nt, Artificial Sequence; identical to SEQ ID NO: 35990
  hemagglutinin__InfluenzaA__ADO30417

SEQ ID NO: 36671 - RNA, 1701 nt, Artificial Sequence; identical to SEQ ID NO: 35599
  hemagglutinin__InfluenzaA__ADO33202

SEQ ID NO: 36672 - RNA, 1701 nt, Artificial Sequence; identical to SEQ ID NO: 36316
  hemagglutinin__InfluenzaA__ADO33240

SEQ ID NO: 36673 - RNA, 1701 nt, Artificial Sequence; identical to SEQ ID NO: 33173
  hemagglutinin__InfluenzaA__ADO33247

SEQ ID NO: 36674 - RNA, 1701 nt, Artificial Sequence; identical to SEQ ID NO: 36316
  hemagglutinin__InfluenzaA__ADO33254

SEQ ID NO: 36675 - RNA, 1701 nt, Artificial Sequence; identical to SEQ ID NO: 36316
  hemagglutinin__InfluenzaA__ADO33261

SEQ ID NO: 36676 - RNA, 1701 nt, Artificial Sequence; identical to SEQ ID NO: 36316
  hemagglutinin__InfluenzaA__ADO33269

SEQ ID NO: 36677 - RNA, 1701 nt, Artificial Sequence
  hemagglutinin__InfluenzaA__ADO33277
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagagaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaauccagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36678 - RNA, 1701 nt, Artificial Sequence; identical to SEQ ID NO: 36316
  hemagglutinin__InfluenzaA__ADO33285

SEQ ID NO: 36679 - RNA, 1701 nt, Artificial Sequence; identical to SEQ ID NO: 35599
  hemagglutinin__InfluenzaA__ADO33293

SEQ ID NO: 36680 - RNA, 1701 nt, Artificial Sequence; identical to SEQ ID NO: 35599
  hemagglutinin__InfluenzaA__ADO33307

SEQ ID NO: 36681 - RNA, 1701 nt, Artificial Sequence; identical to SEQ ID NO: 36316
  hemagglutinin__InfluenzaA__ADO33313

SEQ ID NO: 36682 - RNA, 1701 nt, Artificial Sequence
  hemagglutinin__InfluenzaA__ADO33329
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36683 - RNA, 1701 nt, Artificial Sequence; identical to SEQ ID NO: 36316
  hemagglutinin__InfluenzaA__ADO33337

SEQ ID NO: 36684 - RNA, 1701 nt, Artificial Sequence; identical to SEQ ID NO: 36316
  hemagglutinin__InfluenzaA__ADO33345

SEQ ID NO: 36685 - RNA, 1701 nt, Artificial Sequence; identical to SEQ ID NO: 35599
  hemagglutinin__InfluenzaA__ADO33352

SEQ ID NO: 36686 - RNA, 1701 nt, Artificial Sequence; identical to SEQ ID NO: 34631
  hemagglutinin__InfluenzaA__ADO33360

SEQ ID NO: 36687 - RNA, 1701 nt, Artificial Sequence; identical to SEQ ID NO: 36316
  hemagglutinin__InfluenzaA__ADO33368

SEQ ID NO: 36688 - RNA, 1701 nt, Artificial Sequence; identical to SEQ ID NO: 36316
  hemagglutinin__InfluenzaA__ADO33376

SEQ ID NO: 36689 - RNA, 1701 nt, Artificial Sequence; identical to SEQ ID NO: 33197
  hemagglutinin__InfluenzaA__ADO33384

SEQ ID NO: 36690 - RNA, 1701 nt, Artificial Sequence; identical to SEQ ID NO: 33173
  hemagglutinin__InfluenzaA__ADO33391

SEQ ID NO: 36691 - RNA, 1701 nt, Artificial Sequence
  hemagglutinin__InfluenzaA__ADO79917
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucgagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacaauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagaugggugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36692 - RNA, 1701 nt, Artificial Sequence
  hemagglutinin__InfluenzaA__ADO79923
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguacagacaaauggacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcuauaagacccaaagugagggaucaagaacggagaaugaacuauuacuggacacuaguacagccgggagacaaaauaacauuccaagcaacuggaaaucuagugguaccgagauaugcauucgcaauggaaagaaaugcuggaucugguauuaucauuucagauacaccaguccacaauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagaugggugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36693 - RNA, 1701 nt, Artificial Sequence
  hemagglutinin__InfluenzaA__ADO79924
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguacagacaaauggacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucgagaagggagaaugaacuauuacuggacacuaauagagccgggagacaaaauaacauucgaaccaacuggaaaucuagugguaccgagauaugcauucgcaauggaaagaaaugcuggaucugguauuaucauuucagauacaccaguccacaauugcaauaccacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagaugggugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36694 - RNA, 1701 nt, Artificial Sequence
  hemagglutinin__InfluenzaA__ADO79925
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguacacaugaauggacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucgagaagggagaaugaacuauuacuggacacuaguagagcccggagacaaaauaacauucgaagcaccuggaaaucuagugguaccgagauaugcauucgcaauggaaagaaaugcuggaucugguauuaucauuucagauacaccaguccacaauugcaauacaacuugucagacacccaagggugcuauaaacaccagccucccauuucagaauauacauccgaucaaaauuggaaaauguucaaaauauguaaaaagcacaaaauugagacuggccacaggauugaggaaugucccgucuauucaaucuagaggccuauuuggggccauugccgguuucauugaagggggguggacagggaugguagaugggugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36695 - RNA, 1701 nt, Artificial Sequence
  hemagglutinin__InfluenzaA__ADO79926
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguacagacaaauggacguguuacccaggagauuucaucgauuaugaggagcuaagagagcaauugagcucagugucaucauuugaaagguuugagauauuccccaaaacaaguucauggcccaaucaugacucgaacaaagguguaacggcugcauguccucaugcuggagcaaaaagcuucuacaaaaauuuaauauggcuaguuaaaaaaggaaauucauucucaaagcucagcaaaaccuaccuuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaauguuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguaugguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaaugaaaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36696 - RNA, 1701 nt, Artificial Sequence
  hemagglutinin__InfluenzaA__ADO79927
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguacagacaaauggacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcugcagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucuuuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuguucaaucuagaggccuauuuggggccauugccgguuucauugaagggggguggacagggaugguagauggaugguacgguuaucaccaucaaaaugagcaggggucaggauaugcagccgaccugaagagcacacagaaugcaauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaaugaaaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36697 - RNA, 1701 nt, Artificial Sequence
  hemagglutinin__InfluenzaA__ADO79928
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguacagacaaauggacguguuacccaggagauuucaucgauuaugaggagcuaagagagcaauugagcucagugucaucauuugaaagguuugagauauuccccaagacaaauucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36698 - RNA, 1701 nt, Artificial Sequence
  hemagglutinin__InfluenzaA__ADO79929
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguacagacaaauggacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucuuuaucagaaugcagaugcauauguuuuuguggggacaucaagauacagcaagaaguucaagccggaaauagcaauaagacccaaagugaggggucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36699 - RNA, 1701 nt, Artificial Sequence
  hemagglutinin__InfluenzaA__ADO79930
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguacagacaaauggacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucgagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacaauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagaugggugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36700 - RNA, 1701 nt, Artificial Sequence
  hemagglutinin__InfluenzaA__ADO84715
augaaggcaauacuaguaguucugcuauauacauuugcaaccgcaaacgcaggcacauuauguauagguuaccaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacauuuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauaggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36701 - RNA, 1701 nt, Artificial Sequence; identical to SEQ ID NO: 33390
  hemagglutinin__InfluenzaA__ADP95341

SEQ ID NO: 36702 - RNA, 1701 nt, Artificial Sequence
  hemagglutinin__InfluenzaA__ADP95351
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuugaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36703 - RNA, 1701 nt, Artificial Sequence; identical to SEQ ID NO: 36702
  hemagglutinin__InfluenzaA__ADP95361

SEQ ID NO: 36704 - RNA, 1701 nt, Artificial Sequence; identical to SEQ ID NO: 36702
  hemagglutinin__InfluenzaA__ADP95371

SEQ ID NO: 36705 - RNA, 1701 nt, Artificial Sequence; identical to SEQ ID NO: 36702
  hemagglutinin__InfluenzaA__ADP95381

SEQ ID NO: 36706 - RNA, 1701 nt, Artificial Sequence; identical to SEQ ID NO: 36702
  hemagglutinin__InfluenzaA__ADP95391

SEQ ID NO: 36707 - RNA, 1701 nt, Artificial Sequence; identical to SEQ ID NO: 33457
  hemagglutinin__InfluenzaA__ADQ28007

SEQ ID NO: 36708 - RNA, 1701 nt, Artificial Sequence
  hemagglutinin__InfluenzaA__ADQ28008
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugaaauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaacacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36709 - RNA, 1701 nt, Artificial Sequence; identical to SEQ ID NO: 35024
  hemagglutinin__InfluenzaA__ADQ28009

SEQ ID NO: 36710 - RNA, 1701 nt, Artificial Sequence
  hemagglutinin__InfluenzaA__ADQ28010
augaaggcaauacuaguaguucugcuauauacauuugcaaccgcaaaugcagacacauuauguauagguuaucaugcgaacaauucaacagacacuguagacacaguacuagaaaagaauguaacaguaacacacucugucaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaguuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccagaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36711 - RNA, 1701 nt, Artificial Sequence; identical to SEQ ID NO: 33173
  hemagglutinin__InfluenzaA__ADQ28011

SEQ ID NO: 36712 - RNA, 1701 nt, Artificial Sequence
  hemagglutinin__InfluenzaA__ADQ28012
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagaaccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaacaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36713 - RNA, 1701 nt, Artificial Sequence
  hemagglutinin__InfluenzaA__ADQ28013
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuagacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36714 - RNA, 1701 nt, Artificial Sequence
  hemagglutinin__InfluenzaA__ADQ28014
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36715 - RNA, 1701 nt, Artificial Sequence
  hemagglutinin__InfluenzaA__ADQ28015
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaauuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36716 - RNA, 1701 nt, Artificial Sequence; identical to SEQ ID NO: 33173
  hemagglutinin__InfluenzaA__ADQ28016

SEQ ID NO: 36717 - RNA, 1701 nt, Artificial Sequence; identical to SEQ ID NO: 33173
  hemagglutinin__InfluenzaA__ADQ28017

SEQ ID NO: 36718 - RNA, 1701 nt, Artificial Sequence
  hemagglutinin__InfluenzaA__ADQ28018
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaacucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucucgugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36719 - RNA, 1701 nt, Artificial Sequence
  hemagglutinin__InfluenzaA__ADQ28019
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagguaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagcgucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36720 - RNA, 1701 nt, Artificial Sequence
  hemagglutinin__InfluenzaA__ADQ28020
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaggcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccacuuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36721 - RNA, 1701 nt, Artificial Sequence; identical to SEQ ID NO: 35648
  hemagglutinin__InfluenzaA__ADQ28021

SEQ ID NO: 36722 - RNA, 1701 nt, Artificial Sequence
  hemagglutinin__InfluenzaA__ADQ28022
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggaaauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugaggggucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36723 - RNA, 1701 nt, Artificial Sequence
  hemagglutinin__InfluenzaA__ADQ28023
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagauggaguaaagcuggaaucaacaaggauuuaccagauuuuggcgaucuauucaacugucgccaguucauugguacugguagucucccugggggcaaucaguuucuggaugugcuccaaugggucucuacaguguagaauauguauuuaa

SEQ ID NO: 36724 - RNA, 1701 nt, Artificial Sequence; identical to SEQ ID NO: 36715
  hemagglutinin__InfluenzaA__ADQ28024

SEQ ID NO: 36725 - RNA, 1701 nt, Artificial Sequence
  hemagglutinin__InfluenzaA__ADQ28025
auggaggcaauacuaguaguucugcuauauacauuugcaaccgcaaaugcagacacauuauguauagguuaucaugcgaacaauucaacagacacuguagacacagugcuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36726 - RNA, 1701 nt, Artificial Sequence; identical to SEQ ID NO: 33918
  hemagglutinin__InfluenzaA__ADQ28028

SEQ ID NO: 36727 - RNA, 1701 nt, Artificial Sequence
  hemagglutinin__InfluenzaA__ADQ28029
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugaggggucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36728 - RNA, 1701 nt, Artificial Sequence
  hemagglutinin__InfluenzaA__ADQ28030
augaaggcaauacuaguaguucugcuauauacauuugcaaccgcaaaugcagacacauuauguauagguuaucaugcgaacaauucaacagacacuguagacacaguacuagaaaagaauguaacaguaacacacucugucaaccuucuagaagacaagcauaacgggaaacuaugcaaacuaagagggguagccccauugcauuuggguaaauguaacauugcuggcuggauccugggaaauccagagugugaaucgcucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguauaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccagaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36729 - RNA, 1701 nt, Artificial Sequence
  hemagglutinin__InfluenzaA__ADQ28031
augaaggcaauacuaguaguucugcuauauacauuugcaaccgcaaaugcagacacauuauguauagguuaucaugcgaacaauucaacagacacuguagacacaguacuagaaaagaauguaacaguaacacacucugucaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccagaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36730 - RNA, 1701 nt, Artificial Sequence
  hemagglutinin__InfluenzaA__ADQ28032
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcugcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaccaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36731 - RNA, 1701 nt, Artificial Sequence
  hemagglutinin__InfluenzaA__ADQ28034
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugaggggucaagaagggagaaugaacuauuacuggacaauaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauagaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36732 - RNA, 1701 nt, Artificial Sequence
  hemagglutinin__InfluenzaA__ADQ28035
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcagacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugaggggucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36733 - RNA, 1701 nt, Artificial Sequence
  hemagglutinin__InfluenzaA__ADQ28036
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuagaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36734 - RNA, 1701 nt, Artificial Sequence
  hemagglutinin__InfluenzaA__ADQ28037
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauucuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36735 - RNA, 1701 nt, Artificial Sequence
  hemagglutinin__InfluenzaA__ADQ28038
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacugcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaaggaggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36736 - RNA, 1701 nt, Artificial Sequence; identical to SEQ ID NO: 33173
  hemagglutinin__InfluenzaA__ADQ28039

SEQ ID NO: 36737 - RNA, 1701 nt, Artificial Sequence; identical to SEQ ID NO: 36715
  hemagglutinin__InfluenzaA__ADQ28040

SEQ ID NO: 36738 - RNA, 1701 nt, Artificial Sequence; identical to SEQ ID NO: 36715
  hemagglutinin__InfluenzaA__ADQ28041

SEQ ID NO: 36739 - RNA, 1701 nt, Artificial Sequence
  hemagglutinin__InfluenzaA__ADQ28043
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugauggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggagagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36740 - RNA, 1701 nt, Artificial Sequence
  hemagglutinin__InfluenzaA__ADQ28044
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccuaggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaucuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36741 - RNA, 1701 nt, Artificial Sequence
  hemagglutinin__InfluenzaA__ADQ28045
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguucucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaaaaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36742 - RNA, 1701 nt, Artificial Sequence
  hemagglutinin__InfluenzaA__ADQ28047
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuaucacuggacacuaguagagccgggagacaaaauaacauucgaagcaacuggaaaucuaguggugccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36743 - RNA, 1701 nt, Artificial Sequence; identical to SEQ ID NO: 33173
  hemagglutinin__InfluenzaA__ADQ28048

SEQ ID NO: 36744 - RNA, 1701 nt, Artificial Sequence
  hemagglutinin__InfluenzaA__ADQ28049
auggaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36745 - RNA, 1701 nt, Artificial Sequence
  hemagglutinin__InfluenzaA__ADQ28050
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacagcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36746 - RNA, 1701 nt, Artificial Sequence
  hemagglutinin__InfluenzaA__ADQ28051
augaaggcaauacuaguaguucugcuauauacauuugcaaccgcaaaugcagacacauuauguauagguuaucaugcgaacaauucaacagacacuguagacacaguacuagaaaagaauguaacaguaacacacucugucaaccuucuagaagacaagcaugacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccagaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36747 - RNA, 1701 nt, Artificial Sequence; identical to SEQ ID NO: 33173
  hemagglutinin__InfluenzaA__ADQ28053

SEQ ID NO: 36748 - RNA, 1701 nt, Artificial Sequence; identical to SEQ ID NO: 33457
  hemagglutinin__InfluenzaA__ADQ28055

SEQ ID NO: 36749 - RNA, 1701 nt, Artificial Sequence
  hemagglutinin__InfluenzaA__ADQ28056
auggaggcaauacuaguaguucugcuauauacauuugcaaccgcagaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36750 - RNA, 1701 nt, Artificial Sequence
  hemagglutinin__InfluenzaA__ADQ28057
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaaugggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccccaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaccaaaaugagcaggggucaggauaugcagccgaccugaagagcacacagaaugccaucgacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaagaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36751 - RNA, 1701 nt, Artificial Sequence
  hemagglutinin__InfluenzaA__ADQ28058
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccggagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauaugucuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuagacauuuggacuuacaaugccgaacuguugguucuauuggaaaaugaaagaacuuuggacuaccacgauucaaaugugaaaaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36752 - RNA, 1701 nt, Artificial Sequence
  hemagglutinin__InfluenzaA__ADQ28059
augaaggcaauacuaguaguucugcuauauacacuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugauggcuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36753 - RNA, 1701 nt, Artificial Sequence
  hemagglutinin__InfluenzaA__ADQ28060
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaccaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuagacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggaccuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36754 - RNA, 1701 nt, Artificial Sequence
  hemagglutinin__InfluenzaA__ADQ28061
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguagauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcaaauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36755 - RNA, 1701 nt, Artificial Sequence
  hemagglutinin__InfluenzaA__ADQ28063
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacauguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugaggaaucaagaagggagaaugaacuaucacuggacacuaguaaagccgggagacaaaauaacauucgaagcaacuggaaaucuagugguaccgagauaugcauucgcaguggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagauggggugaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36756 - RNA, 1701 nt, Artificial Sequence
  hemagglutinin__InfluenzaA__ADQ28064
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugaggaaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaacuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36757 - RNA, 1701 nt, Artificial Sequence
  hemagglutinin__InfluenzaA__ADQ28065
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaauaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcuggccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacacaaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaauguagaauauguauuuaa

SEQ ID NO: 36758 - RNA, 1701 nt, Artificial Sequence
  hemagglutinin__InfluenzaA__ADQ28066
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccagagugagggaucaagaagggagaaugaacuauuacuggacacuaguagagccaggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaagggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36759 - RNA, 1701 nt, Artificial Sequence
  hemagglutinin__InfluenzaA__ADQ28067
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaacugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauaaaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36760 - RNA, 1701 nt, Artificial Sequence
  hemagglutinin__InfluenzaA__ADQ28068
augaaggcaauacuaguaguucugcuauauacauuuacaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagaaaaaagcuucuacaaaaauuuaauauggcuaguuaaaaaaggaaauucauacccaaagcucagcaaauccuacauuaaugauaaagggaaagaaguccucgugcuauggggcauucaucauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuaucacuggacacuaguaaagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuuuauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36761 - RNA, 1701 nt, Artificial Sequence
  hemagglutinin__InfluenzaA__ADQ28069
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcuguagguaaagaguucaaccaccuggaaaaaagaauagagaauuuaaauaaaaaaguugaugaugguuuccuggacauuuggacuuacaaugcugaacugcugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauaaaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36762 - RNA, 1701 nt, Artificial Sequence
  hemagglutinin__InfluenzaA__ADQ28070
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuauccaggagauuucaucgauuaugaggagcuacgagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucuaaugugaagaacuuauaugaaaagguaagaagacaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36763 - RNA, 1701 nt, Artificial Sequence
  hemagglutinin__InfluenzaA__ADQ28071
augaaggcaauacuaguaguucugcuauauacacuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaucagauuuuggcgaucuauucaacugucgccaguucauugguacugguagucucccugggggcaaucaguuucuggaugugcucuaaugggucucuacaguguagaauauguauuuaa

SEQ ID NO: 36764 - RNA, 1701 nt, Artificial Sequence; identical to SEQ ID NO: 34117
  hemagglutinin__InfluenzaA__ADR32361

SEQ ID NO: 36765 - RNA, 1689 nt, Artificial Sequence
  hemagglutinin__InfluenzaA__ADT78887
auggcccucauuuaucucauacuccuguucacaucagugaggggggaccagauaugcauuggauaccaugccaauaauuccacagaaaaggucgacacaauucuagagcggaaugucacugugacucaugccaaggacauccuugagaagacccauaacggaaagcuaugcaaacuaaacggaaucccuccacuugaacuaggggacuguagcauugccggauggcuccuuggaaauccagaaugugauaggcuucuaagggugccagaaugguccuauauaauggagaaagaaaacccgaaauacaguuuguguuacccaggcagcuucaaugacuaugaagaauugaaacaucucaucagcagcguaaaacauuucgagaaaguaaagauucugcccaaagauggauggacacagcauacaacaacuggagguucaagggccugcgcggugucagguaacccaucauucuucaggaacauggucuggcugacaaagaaaggaccaaauuauccgguugccaaaggaucguacaacaauacgagcggagaacaaaugcuaauaauuuggggagugcaccauccuaaugaugaggcagaacaaagagcauuguaccagaaagugggaaccuauguuucugcaagcacaucaacauugaacaaaaggucaaccccagaaauagcagcaaggccugaagugaauggacuaggaaguagaauggaauucucuuggacccucuuggauaugugggacaccauaaauuuugagagcacugguaaucuaguugcaccagaguauggauucaaaauaucgaaaagagguaguucaggggucaugaagacagaaggaacacuugagaacugugagaccaaaugccaaacuccuuugggagcaauaaauacaacacuaccuuuucacaauguccacccacugacaauaggugaaugccccaaauauguaaaaucggagaaauuggucuuagcaacaggacuaaggaauguuccccagauugaaucaagaggauuguuuggggcaauagcugguuuuauagaaggaggauggcaaggaaugguugaugguugguauggauaccaucacagcaaugaccagggaucaggguaugcagcagacaaagaauccacucaaaaggcauuugauggaaucaccaacaagguaaauucugugauugaaaagaugaacacccaauuugaagcuguugggaaagaauucagcaacuuagagaaaagacuggagaacuugaacaaaaagauggaagacggguuucuagauguguggacauacaaugcugagcuucuaguucugauggaaaaugagaggacacuugacuuucaugauucuaaugucaagaaucuguaugauaaagucagaaugcagcugagagacaacgucaaagaacuaggaaauggauguuuugaauuuuaucacaaaugugacgaugaaugcauggauagugugaaaaacgggacauaugauuaucccaaguaugaagaagaaucuaaacuaaauagaaaugaaaucaaagggguaaaauugagcagcauggggguuuaucaaauccuugccauuuaugcuacaguagcagguucucugucacuggcaaucaugauggcugggaucucuuucuggaugugcuccaacgggucucugcagugcagaaucugcauauga

SEQ ID NO: 36766 - RNA, 1701 nt, Artificial Sequence
  hemagglutinin__InfluenzaA__ADT78908
augaaagcaaaacuacugauccuguuaugugcacuuucagcuacagaugcagacacaauauguauaggcuaccaugcgaacaacucaaccgacacuguugacacaguacucgaaaagaaugugacagugacacacucuguaaaccuacucgaagacagccacaaugggaaauuaugcagauuaaaaggaaaagccccacuacaauuggggaaauguaacauugccggaugggucuuaggaaacccagaaugcgaaucauugcuuuccaauagaucaugguccuacauugcagaaacaccaaacucugagaaugggacauguuacccaggagauuucgccgacuaugaggaacugagggagcaauugagcucaguaucaucauucgagagauucgaaauauuccccaaggaaagaucauggcccaaacacaacacaaccagaggagugacggcagcaugcucccaugcgaggaaaagcaguuuuuacaaaaauuuggucuggcugacggaggcaaauggcucauacccaaaucugagcaaguccuaugugaacaaucaagagaaagaaguccuugugcuaugggguguucaucacccgucuaacauagaggaucaaagaacccucuaucggaaagauaaugcuuaugucucuguagugucuucaaauuauaacaggagauucaccccagaaauagcaaaaaggcccaaaguaagagaucaaccagggagaaugaacuauuacuggacuuugcuagaacccggagacacaauaauauuugaggcaacuggaaaucuaauagcaccaugguaugcuuucgcacugaguagaggcccuggaucaggaaucaucaccucaaacgcaccaauggaugaaugugacacgaagugucaaacaccccagggagcuauaaacaguagucucccuuuucagaauauacacccagucacaauaggagagugcccaaaauacgucaggaguacaaaauugaggaugguuacaggacuaaggaacaucccauccauccaauccaggggucuguuuggagccauugccgguuucauugaagggggauggacugggaugauggauggaugguaugguuaccaucaucagaaugaacagggaucuggcuaugcugcggaucaaaaaagcacacaaaaugccauuaacgggauuacaaauaaggugaacucuguuaucgagaaaaugaacacucaauucacagcuguggguaaagaauucaacaaauuagaaaaaagaauggaaaacuuaaauaaaaaaguugaugauggauuucuggauauuuggacauauaaugcagaauuguugguucuacuggaaaaugaaaggacuuuggauuuucaugacucaaaugugaagaaucuguaugagaaaguaaaaaaccaauuaaggaauaaugcaaaggaacuaggaaacggguguuuugaguucuaccacaagugugacaaugaaugcauggaaaguguaaaaaauggaacuuaugauuacccaaaauauucagaggaaucaaaguuaaacagagaaaagauugauggagugaaauuggaaucaaugggggucuaucggauucuggcgaucuacucaacugucgccaguucacuggugcuucuggucucccugggggcaaucagcuucuggauguguucuaaugggucuuuacagugcagaauaugcaucuga

SEQ ID NO: 36767 - RNA, 1701 nt, Artificial Sequence
  hemagglutinin__InfluenzaA__ADT78929
augaaagcaaaacuacugauccuguuaugugcacuuucagcuacagaugcagacacaauauguauaggcuaccaugcgaacaacucaaccgacacuguugacacaguacucgaaaagaaugugacagugacacacucuguaaaccuacucgaagacagccacaacgggaaauuaugcagauuaaaaggaauagccccacuacaauuggggaaauguaacauugccggauggaucuuaggaaacccagaaugcgaaucacugcuuucuaagagaucaugguccuacauugcagaaacaccaaacucugagaauggaacauguuacccaggagauuucgccgacuaugaggaacugagggagcaauugagcucagugucaucauucgagagauucgaaauauuccccaaggaaagaucauggcccaaacacaacauaaccagaggaguaacggcagcaugcucccaugcggggaaaagcaguuuuuacaaaaauuugcucuggcugacggagacaaaaggcucauacccaaaucugagcaaguccuaugugaacaauaaagagaaagaaguccuugugcuaugggguguucaucacccgucuaacauagaggaucaaaagacccucuaucggaaagaaaaugcuuaugucucuguagugucuucaaauuauaacaggagauucaccccggaaauagcagaaagacccaaaguaagaggucaagcagggagaaugaacuauuacuggacuuugcuagaacccggagacacaauaauauuugaggcaaauggaaaucuaauagcgccaugguaugcuuucgcacugaguagaggccuuggaucaggaaucaucaccucaaacgcaucaauggaugaaugugacacgaagugucaaacaccccagggagcuauaaacaguagucucccuuuucagaauauacacccagucacaauaggagagugcccaaaauacgucaagaguaccaaauugaggaugguuacaggauuaaggaacaucccauccauucaauccagaggucuguuuggagccauugccgguuucauugaggggggauggacuggaaugauagauggaugguaugguuaccaucaucagaaugaacagggaucuggcuaugcugcggaucaaaaaagcacacaaaaugccauuaacgggauuacaaauaaggugaacucuguuaucgagaaaaugaacacucaauucacagcuguggguaaagaauucaacaaauuagaaaaaagaauggaaaacuuaaauaaaaaaguugaugauggauuucuggacauuuggacauauaaugcagaauuguugguucuacuggaaaaugaaaggacuuuggauuuccaugacucaaaugugaagaaucuguaugagaaaguaaaaaaccaauuaaggaauaaugcaaaggaaauaggaaacggguguuuugaguucuaccacaaguguaacaaugaaugcauggaaaguguaaaaaauggaacuuaugauuacccaaaauauucagaggaaucaaaguuaaacagggaaaaaauugauggagugaaauuggaaucaaugggggucuaucagauucuggcgaucuacucaacugucgccaguucacuggugcuucuggucucccugggggcaaucagcuucuggauguguucuaaugggucuuugcaaugcagaauaugcaucuga

SEQ ID NO: 36768 - RNA, 1701 nt, Artificial Sequence
  hemagglutinin__InfluenzaA__ADT78936
augaaagcaaaacuacugguccuguuaugugcacuuucagcuacauaugcagacacaauauguauaggcuaccaugcgaacaacucaaccgacacuguugacacaguacucgaaaagaaugugacagugacacacucuguaaaccuacucgaagacagccacaacgggaaauuaugcagauuaaaaggaaaagccccacuacaauuggggaaauguaacauugccggauggaucuuaggaaacccagaaugcgaaucacugcuuuccaaaagaucaugguccuacauugcagaaacaccaaacucugagaauggaacauguuacccaggagauuucgccgacuaugaggaauugagggagcaauugagcucaguaucaucuuucgagagauucgaaauauuccccaaggaaaguucauggcccaaacacaacacaaccagaggagugacggcagcaugcucccaugcgaggaaaagcaguuuuuacaaaaauuugcucuggcugacggaggcaaauggcucauacccaaaucugagcaaguccuaugugaacaaucaagagaaagaaguccuugugcuaugggguguucaucacccgucuaacauagaggaucaaaggacccucuaucggaaagaaaaugcuuaugucucuguagugucuucaaauuauaacaggagauucaccccagaaauagcagaaaggcccaaaguaagaaaucaagcagggagaaugaacuauuacuggacuuugcuagaacccggagacacaauaauauuugaggcaaauggaaaucuaauagcaccaugguaugcuuucgcacugaguagaggccuuggaucaggaaucaucaccucaaacgcaucaauggaugaaugugacacgaagugucaaacaccccagggagcuauaaacaguagucucccuuuucagaauauacacccagucacaauaggagagugcccaaaauacguaaagaguacaaaauugagaaugguuacaggacuaaggaacauaccauccauucaauccaggggucuauuuggagccauugccgguuucauugaagggggauggacugggaugauggauggaugguaugguuaccaucaucagaaugaacagggaucuggcuaugcugcggaucaaaaaagcacacaaaaugccauuaacgggauuacaaauaaggugaacucuguuaucgagaaaaugaacacucaauucacagcuguggguaaagaauucaacaaauuagaaaaaagaauggaaaacuuaaauaaaaaaguugaugauggauuucuggauauuuggacauauaaugcagaauuguuaguucuacuggaaaaugaaaggacuuuggauuuccaugacucaaaugugaagaaucuguaugagaaaguaaaaaaccaauuaaggaauaaugcaaaggaacuaggaaacggguguuuugaguucuaucacaagugugacaaugaaugcauggaaaguguaaaaaauggaacuuaugauuacccaaaauauucagaggaaucaaaguuaaacagggaaaagauugauggagugaaauuggaaucaaugggggucuaucggauucuggcgaucuacucaacugucgccaguucacuggugcuucuggucucccugggggcaaucagcuucuggauguguucuaaugggucuuuacagugcagaauaugcaucuga

SEQ ID NO: 36769 - RNA, 1689 nt, Artificial Sequence
  hemagglutinin__InfluenzaA__ADT78961
auggccaucauuugucucauucuccuguucacagcagugagaggggaccagauaugcauuggauaccaugccaauaauuccacagagaaggucgacacaauucuagagcggaacgucacugugacucaugccaaggacauccuugagaagacccauaacggaaaguuaugcaaacuaaacggaaucccuccacuugaacuaggggacuguaguauugccggauggcuccuuggaaauccagaaugugauaggcuucuaagugugccagaaugguccuauauaauggaaaaagaaaacccgagagacgguuuguguuauccaggcagcuucaaugauuaugaagaauugaaacaucuccucagcagcguaaaacauuucgagaaaguaaagauucugcccaaaaauagauggacacagcauacaacaacuggagguucacgggccugcgcggugucuggcaauccaucauucuucaggaacauggucuggcugacaaagaaaggaucaaauuauccgguugccaaaggaucguacaacaauacaagcggagaacaaaugcuaauaauuuggggggugcaccaucccaaugaugagacagaacaaagaacauuguaccagaauguggaaaccuauguuuccguaagcacaucaacacugaacaaaaggucaaccccaaaaauugcaacaaggccugaagugaauggacuaggaaguagaauggaauucucuuggacccucuuggauaugugggacaccauaaauuuugagagcacugguaaucuaauugcaccagaguauggauucaaaauaucgaaaagagguaguucagggaucaugaagacagaaggaacacuugagaacugugagaccaaaugccaaacuccucugggagcaauaaauacaacauugccuuuucacaauguccacccacugacaauaggugagugccccaaauauguaaaaucggagaaauuggucuuagcaacaggaccaaggaauguuccccagauugaaucaagaggauuguuuggggcaauagcugguuuuauagaaggaggauggcaaggaaugguugaugguugguauggauaccaucacagcaaugaccagggaucaggguaugcagcagacaaagaaucuacucaaaaggcauuugauggaaucaccaacaagguaaauucugugauugaaaagaugaacacccaauuugaagcuguugggaaagaauucaguaacuuagagagaagacuggagaacuugaacaaaaagauggaagacggguuucuagauguguggacauacaaugcugagcuucuaguucugauggaaaaugagaggacacuugacuuccaugauucuaaugucaagaaucuguaugauaaagucagaaugcagcugagagacaacgucaaagaacuaggaaauggauguuuugaauuuuaucacaaaugugaugaugaaugcaugaauagugugaaaaacgggacguaugauuaucccaaguaugaagaagaaucuaaacuaaauagaaaugaaaucaaagggguaaaauugagcagcauggggguuuaucaaauccuugucauuuaugcuacaguagcagguucucugucacuggcaaucaugauggcugggaucucuuucuggaugugcuccaacgggucucugcagugcaggaucugcauauga

SEQ ID NO: 36770 - RNA, 1701 nt, Artificial Sequence; identical to SEQ ID NO: 31268
  hemagglutinin__InfluenzaA__ADT78971

SEQ ID NO: 36771 - RNA, 1701 nt, Artificial Sequence
  hemagglutinin__InfluenzaA__ADT79010
augaagacuaucauugcuuugagcuacauuuucugucugguucucggccaagauuuuccaggaaaugacaacagcacagcaacgcugugccugggacaucaugcggugccaaacggaacacuagugaaaacaaucacaaaugaucagauugaagugacuaaugcuacugagcugguucagaguuccucaacggggaaaauaugcaacaauccucaucgaauccuugauggaauagacugcacacugauagaugcucuauugggggacccucauugugauggcuuucaaaaugagacaugggaccuuuucguugaacgcagcaaagcuuucagcaacuguuacccuuaugaugugccagauuaugccucccuuaggucacuaguugccucgucaggcacucuggaguuuaucaaugaaggcuucacuuggacuggggucacucagaaugggggaagcaaugcuugcaaaaggggaccugauagcgguuuuuucaguagacugaacugguuguacaaaucaggaagcacauauccagugcugaacgugacuaugccaaacaaugacaauuuugacaaacuauacauuugggggguucaccacccgagcacggaccaagaacaaaccagccuauauguucaagcaucagggagagucacagucucuaccaagagaagccagcaaacuauaaucccgaauaucgggucuagacccuggguaaggggucugucuaguagaauaagcaucuauuggacaauaguuaaaccaggagacauacugguaauuaauaguaaugggaaccuaauugcuccucgggguuauuucaaaaugcgcacugggaaaagcucaauaaugaggucagaugcaccuauuggcaccugcauuucugaaugcaucacuccaaauggaagcauucccaaugacaagcccuuucaaaacguaaacaagaucacauauggggcaugucccaaguauguuaagcaaaacacccugaaguuggcaacagggaugcgaaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaacugaauaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaaugggacuuaugaccaugauguauacagagacgaagcauuaaacaaccgguuucagaucaaagguguugaacugaagucaggauacaaagacuggauccuguggauuuccuuugccauaucaugcuuuuugcuuuguguuguuuugcugggguucaucaugugggccugccagaaaggcaacauuaggugcaacauuugcauuuga

SEQ ID NO: 36772 - RNA, 1701 nt, Artificial Sequence; identical to SEQ ID NO: 31268
  hemagglutinin__InfluenzaA__ADT79030

SEQ ID NO: 36773 - RNA, 1701 nt, Artificial Sequence
  hemagglutinin__InfluenzaA__ADT79050
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuucguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggaggucuaauaaaaguuucuuuaguagauugaauugguugcaccaauuaaaauacaaauacccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggugcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaauggcuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 36774 - RNA, 1701 nt, Artificial Sequence
  hemagglutinin__InfluenzaA__ADT79108
augaaagcaagacuacugauccuguuaugugcacuuucagcuacagaugcagacacaauauguauaggcuaccaugcgaacaauucaaccgacacuguugacacaguacucgaaaagaaugugacagugacacacucuguaaaccuacucgaagacagccacaacgggaaauuaugcagauuaaaaggaauagccccacuacaauuggggaaauguaacauugccggauggaucuugggaaacccagaaugcgaaucauugcucucuaauagaucaugguccuacauugcagaaacaccaaacucugagaauggaacauguuacccaggagauuucgccgacuaugaggaacugagggagcaauugagcucaguaucaucauucgagagauucgaaauauuccccaaggaaagaucauggcccaaacacaacauaaccagaggaguaacggcagcaugcucccacgcgaagaaaagcaguuuuuacaaaaauuugcucuggcugacggaggcaaauggcucauacccaaaucugaucaaguccuaugugaacaacaaagagaaagaaguccuugugcuaugggguguucaucacccgucuaacauagaggaucaaaggacccucuaucggaaagaaaaugcuuaugucucuguggugucuucaaauuauaacaggagauucaccccggaaauagcagaaagacccaaaguaagaggucaagcagggagaaugaacuauuacuggacuuugcuagaacccggagacaaaauaauauuugaggcaaauggaaaccuaauagcgccaugguaugcuuucgcacugaguagaggccuuggaucaggaaucaucaccucaaacgcaucaauggaugaaugugacacgaagugucaaacaccccagggagcuauaaacaguagucucccuuuucagaacauacacccagucacaauaggagagugcccaaaauaugucaggaguaccaaauugaggaugguuacaggacuaaggaacaucccauccauucaauccagaggucuguuuggagccauugccgguuucauugaagggggauggacuggaaugguagauggaugguaugguuaccaucaucaaaaugaacagggaucuggcuaugcugcggaucaaaaaagcacacaaaaugccauuaacgggauuacaaauaaggugaacucuguuaucgagaaaaugaacacucaauucacagcuguggguaaagaauucaacaaauuggaaaaaagaauggaaaacuuaaauaaaaaaguugaugauggauuucuggacauuuggacauauaaugcagaauuguugguucuacuggaaaaugaaaggacuuuggauuuccaugacucaaaugugaagaaucuguaugagaaaguaaaaaaccaauugagaaauaaugcaaaggaaauaggaaacggguguuuugaguucuaccacaagugugacaaugaaugcauggaaaguguaaaaaauggaacuuaugauuacccaaaguauucagaggaaucaaaguuaaacagggaaaaaauugauggagugaaauuggaaucaaugggggucuaucagauucuggcgaucuacucaacugucgccaguucacuggugcuucuggucucccugggggcaaucagcuucuggauguguuccaaugggucuuugcaaugcagaauaugcaucuga

SEQ ID NO: 36775 - RNA, 1689 nt, Artificial Sequence
  hemagglutinin__InfluenzaA__ADT79119
auggccaucauuuaucucauucuccuguucacagcagugagaggggaccagauaugcauuggauaccaugccaauaauuccacagagaaggucgacacaauucuagagcggaacgucacugugacucaugccaaggacauucuugagaagacccauaacggaaaguuaugcaaacuaaacggaaucccuccacuugaacuaggggacuguagcauugccggauggcuccuuggaaauccagaaugugauaggcuucuaagugugccagaaugguccuauauaauggagaaagaaaacccgagagacgguuuguguuauccaggcagcuucaaugauuaugaagaauugaaacaucuccucagcagcgugaaacauuucgagaaaguaaagauucugcccaaagauagauggacacagcauacaacaacuggagguucacgggccugcgcggugucugguaauccaucauucuucaggaacauggucuggcugacaaagaaaggaucaaauuauccgguugccaaaggaucguacaacaauacaagcggagaacaaaugcuaauaauuuggggggugcaccaucccaaugaugagacagaacaaagaacauuguaccagaaugugggaaccuauguuuccguaggcacaucaacauugaacaaaaggucaaccccagacauagcaacaaggccuaaagugaauggacuaggagguagaauggaauucucuuggacccuauuggauaugugggacaccauaaauuuugagaguacugguaaucuaauugcaccagaguauggauucaaaauaucgaaaagagguaguucagggaucaugaaaacagaaggaacacuugggaacugugagaccaaaugccaaacuccuuugggagcaauaaauacaacauugccuuuucacaauguccacccacugacaauaggugagugccccaaauauguaaaaucggagaaguuggucuuagcaacaggacuaaggaauguuccccagauugaaucaagaggauuguuuggggcaauagcugguuuuauagaaggaggauggcaaggaaugguugaugguugguauggauaccaucacagcaaugaccagggaucaggguaugcagcagacaaagaauccacucaaaaggcauuugauggaaucaccaacaagguaaauucugugauugaaaagaugaacacccaauuugaagcuguugggaaagaauucaguaacuuagagagaagacuggagaacuugaacaaaaagauggaagacggguuucuagauguguggacauacaaugcugagcuucuaguucugauggaaaaugagaggacacuugacuuucaugauucuaaugucaagaaucuguaugauaaagucagaaugcagcugagagacaacgucaaagaacuaggaaauggauguuuugaauuuuaucacaaaugugaugaugaaugcaugaauagugugaaaaacgggacguaugauuaucccaaguaugaagaagagucuaaacuaaauagaaaugaaaucaaagggguaaaauugagcagcauggggguuuaucaaauccuugccauuuaugcuacaguagcagguucucugucacuggcaaucaugauggcugggaucucuuucuggaugugcuccaacgggucucugcagugcaggaucugcauauga

SEQ ID NO: 36776 - RNA, 1689 nt, Artificial Sequence
  hemagglutinin__InfluenzaA__ADT79129
auggccaucauuuaucucauucuccuguucacagcagugagaggggaccaaauaugcauuggauaccaugccaauaauuccacagagaaggucgacacaauucuagagcggaacgucacugugacucaugccaaggacauucuugagaagacccauaacggaaaguuaugcaaacuaaacggaaucccuccacuugaacuaggggacuguagcauugccggauggcuccuuggaaauccagaaugugauaggcuucuaagagugccagaaugguccuauauaauggagaaagaaaacccgagagacgguuuguguuauccaggcagcuucaaugauuaugaagaauugaaacaucuccucagcagcgugaaacauuucgagaaaguaaagauucugcccaaagauagauggacacagcauacaacaacuggagguucacgggccugcgcggugucugguaauccaucauucuucaggaacaugaucuggcugacaaagaaaggaucaaauuauccgguugccaaaggaucguacaacaacacaagcggagaacaaaugcuaauaauuuggggggugcaccaucccaaugaugagacagaacaaagaacauuguaccagaaugugggaaccuauguuuccguagucacaucaacauugaacaaaaggucaaccccgaaaauagcaacaaggccuaaagugaauggacuaggagguagaauggaauucucuuggacccuauuggauaugugggacaccauaaauuuugagaguacugguaaucuaauugcuccagaguauggauucaaaauaucgaaaagaggcaguucagggaucaugaaaacagaaggaacacuugagaacugugagaccaaaugccaaacuccuuugggagcaauaaauacaacauugccuuuucacaauguccacccacuggcaauaggugagugccccaaauauguaaaaucggagaaguuggucuuagcaacaggacuaaggaauguuccccagauugaaucaagaggauuguuuggggcaauagcuggcuuuauagaaggaggauggcaaggaaugguugaugguugguauggauaccaucacagcaaugaccagggaucaggguaugcagcagacaaagaauccacucaaagggcauuugauggaaucacuaacaagguaaauucugugauugaaaagaugaacacccaauuugaagcuguugggaaagaauucaguaacuuagagagaagacuggagaacuugaacaaaaagauggaagacggguuucuagauguguggacauacaaugcugagcuucuaguucugauggaaaaugagaggacacuugacuuucaugauucuaaugucaagaaucuguaugauaaagucagaaugcagcugagagacaacgucaaagaacuaggaaauggauguuuugaauuuuaucacaaaugugaugaugagugcaugaauagugugaaaaacgggacguaugauuaucccaaguaugaagaagagucuaaacuaaauagaaaugaaaucaaagggguaaaauugagcagcauggggguuuaucaaauccuugccauuuaugcuacaguagcagguucucugucacuggcaaucaugauggcugggaucucuuucuggaugugcuccaacgggucccugcagugcaggaucugcauauga

SEQ ID NO: 36777 - RNA, 1701 nt, Artificial Sequence
  hemagglutinin__InfluenzaA__ADT79232
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauaaacauccgaucacaauuggaaaauguccaaaauauguaaaaagcacaaaauugagacuggccacaggauugaggaaugucccgucuauucaaucuagaggccuauuuggggccauugcugguuucauugaagggggguggacagggaugguagauggaugguacgguuaucaccaucaaaaugagcaggggucaggauaugcagccgacgugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36778 - RNA, 1701 nt, Artificial Sequence
  hemagglutinin__InfluenzaA__ADT79242
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaccuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36779 - RNA, 1701 nt, Artificial Sequence
  hemagglutinin__InfluenzaA__ADT91182
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaccacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacgacagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaccuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggcaacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgggauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauacgaaaagguaagaagccaguuaaaaaacaaugccaaggaaauuggaaacggcugcuuugaauuuuaccacaaaugugauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36780 - RNA, 1701 nt, Artificial Sequence
  hemagglutinin__InfluenzaA__ADU20561
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaggagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggagauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucaaaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaauaaugccaaggaaauugggaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36781 - RNA, 1701 nt, Artificial Sequence
  hemagglutinin__InfluenzaA__ADU20562
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaaaauugcuggauggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggagauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucaaaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauugggaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36782 - RNA, 1701 nt, Artificial Sequence
  hemagglutinin__InfluenzaA__ADU25478
auggaagcaaaauuguuuguacuauucugugcauucacugcgcugaaagcugacacuauuuguguaggcuaucaugcuaacaauuccacagacacugucgacacaauacuggagaggaaugugacuguuacccauucaguuaauuugcuagaaagcagccacaauggaaaacucugcagccuaaauggaaaggccccauuacaacugggaaacugcaacguagcaggauggauccuuggcaacccagaaugcgacuugcugcucacagugaauucguggucuuacauaauagagacuucaacuucaaaaaauggggcaugcuauccuggagaauucgcugauuaugaggaauuaagggagcagcugaguacgguuucuucauuugaaagauuugaaauuuucccaaaagcaaccucauggccaaaucaugagacaaccaaagguacuacaguugcaugcucccacucuggagcaaacaguuuuuaucggaacuugcuauggauaguaaaaaagggaaacuccuauccuaagcucagcaagucauacacaaacaacaaaggaaaagaagugcuuguaaucuggggaguucaucacccuccgacugacagugaucaacaaacccuuuaccagaauaaucacacauauguuucaguuggaucaucaaaauacuaccaaagguucacaccagaaauagugaccagaccuaaagucagagagcaagcgggcagaaugaauuauuacuggacacuauuagaucaaggagacaccauaacuuuugaagccacggggaauuuaauagcaccauggcaugcauuugcauugaauaaggguucuaguucuggaauuaugaugucggaugcucauguucacaauugcacuacaaagugccaaacuccucauggggcuuugaaaagcaaucuuccuuuucagaauguacaucccaucacuauuggagaaugccccaaauauguuaaaagcacccaacuaagaauggcaacaggauuaaggaauauccccucuauucaauccagaggacuuuuuggggcaauugccggauucauugaaggaggauggacaggaaugauagaugggugguauggauaucaccaucaaaaugagcaggggucugguuacgcagcagaucagaaaaguacacaaauugcaauugaugggaucagcaacaaaguaaacucaguaauugaaaaaaugaauguucaauuuacuucagugggcaaagaguucaauaaucuagaaaaaaggauugagaauuugaauaaaaaggucgaugauggauuuuuggauauauggacuuauaacgcugaauuacucauccugcucgagaacgaaagaacccuagauuuccaugacuuuaacgugaaaaaucuguaugaaagggucaagucacaacuaagaaacaaugccaaggagaucgguaauggcuguuuugaguucuaucacaaauguaauaaugaaugcauggaaagcguaaagaauggcacauauaauuauccuagauauucagaagaauccaaauugaauagagaggaaauagacgguguaaaacuagaaucagugggaguucaucagauuuuggcgaucuacuccacagucgccaguucccugguauugcuagucucccugggggcaaucagcuucuggaugugcucuaaugggucauugcaaugcagaauaugcauuuaa

SEQ ID NO: 36783 - RNA, 1701 nt, Artificial Sequence
  hemagglutinin__InfluenzaA__ADU59558
augaaggcaauacuaguaguucugcuauauacauuugcaaccgcaaaugcagacacauuauguauagguuaucaugcaaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugaggggucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaagugaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36784 - RNA, 1701 nt, Artificial Sequence
  hemagglutinin__InfluenzaA__ADU59579
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaauaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36785 - RNA, 1701 nt, Artificial Sequence; identical to SEQ ID NO: 33173
  hemagglutinin__InfluenzaA__ADU59590

SEQ ID NO: 36786 - RNA, 1701 nt, Artificial Sequence
  hemagglutinin__InfluenzaA__ADU59601
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccguugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36787 - RNA, 1701 nt, Artificial Sequence; identical to SEQ ID NO: 33173
  hemagglutinin__InfluenzaA__ADU59612

SEQ ID NO: 36788 - RNA, 1701 nt, Artificial Sequence; identical to SEQ ID NO: 33173
  hemagglutinin__InfluenzaA__ADU59768

SEQ ID NO: 36789 - RNA, 1701 nt, Artificial Sequence; identical to SEQ ID NO: 35572
  hemagglutinin__InfluenzaA__ADU59769

SEQ ID NO: 36790 - RNA, 1701 nt, Artificial Sequence; identical to SEQ ID NO: 33173
  hemagglutinin__InfluenzaA__ADU59771

SEQ ID NO: 36791 - RNA, 1701 nt, Artificial Sequence; identical to SEQ ID NO: 33173
  hemagglutinin__InfluenzaA__ADU59772

SEQ ID NO: 36792 - RNA, 1701 nt, Artificial Sequence; identical to SEQ ID NO: 33173
  hemagglutinin__InfluenzaA__ADU59774

SEQ ID NO: 36793 - RNA, 1701 nt, Artificial Sequence; identical to SEQ ID NO: 33173
  hemagglutinin__InfluenzaA__ADU59906

SEQ ID NO: 36794 - RNA, 1701 nt, Artificial Sequence
  hemagglutinin__InfluenzaA__ADU59916
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaagaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36795 - RNA, 1701 nt, Artificial Sequence
  hemagglutinin__InfluenzaA__ADU76756
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36796 - RNA, 1701 nt, Artificial Sequence; identical to SEQ ID NO: 36795
  hemagglutinin__InfluenzaA__ADU76757

SEQ ID NO: 36797 - RNA, 1701 nt, Artificial Sequence; identical to SEQ ID NO: 36795
  hemagglutinin__InfluenzaA__ADU76758

SEQ ID NO: 36798 - RNA, 1701 nt, Artificial Sequence; identical to SEQ ID NO: 36795
  hemagglutinin__InfluenzaA__ADU76759

SEQ ID NO: 36799 - RNA, 1701 nt, Artificial Sequence
  hemagglutinin__InfluenzaA__ADU76761
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggggauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaauagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36800 - RNA, 1701 nt, Artificial Sequence
  hemagglutinin__InfluenzaA__ADU76762
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggacuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36801 - RNA, 1701 nt, Artificial Sequence
  hemagglutinin__InfluenzaA__ADU76764
augaaggcaauacuaguaguucugcuauauacauuugcaaccgcaaaugcagacacauuauguauagguuaucaugcgaacaauucaacagacacuguagacacaguacuagaaaagaaugugacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaagcaucuaguucaaacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuauuauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaacacacaguucauagcaguagguaaagaguucaaccaccuggaaaaaagaauagagaauuuaaauaaaaaaguugaugaugguuuccuggacauuuggacuuacaaugccgaacuguugguucuauuggaaaaugaaagaaccuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36802 - RNA, 1701 nt, Artificial Sequence
  hemagglutinin__InfluenzaA__ADU76765
augaaggcaauacuaauaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaagugucgccaguucauugguacugguagucucccugggggcaaucaguuucuggaugugcucuaaugggucucuacaguguagaauauguauuuaa

SEQ ID NO: 36803 - RNA, 1701 nt, Artificial Sequence; identical to SEQ ID NO: 35358
  hemagglutinin__InfluenzaA__ADU76766

SEQ ID NO: 36804 - RNA, 1701 nt, Artificial Sequence
  hemagglutinin__InfluenzaA__ADU76767
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacuggauugaggaaugucccgucuauucaaucuagaggccuauuuggggccauugccgguuucauugaagggggguggacagggaugguagauggaugguacgguuaucaccaucaaaaugagcagggaucaggauaugcagccgaccugaagagcacacagaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36805 - RNA, 1701 nt, Artificial Sequence
  hemagglutinin__InfluenzaA__ADU76768
augaaggcaauacuaguaguucugcuauauacauuugcaaucgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcaucuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggaauucaccauccaucuacuagugcugaccaacaaagucucuaucagaaugcagaugcauauguuuuuguggggacaucaaaauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauaaaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36806 - RNA, 1701 nt, Artificial Sequence; identical to SEQ ID NO: 36795
  hemagglutinin__InfluenzaA__ADU76769

SEQ ID NO: 36807 - RNA, 1701 nt, Artificial Sequence; identical to SEQ ID NO: 36795
  hemagglutinin__InfluenzaA__ADU76770

SEQ ID NO: 36808 - RNA, 1701 nt, Artificial Sequence; identical to SEQ ID NO: 36795
  hemagglutinin__InfluenzaA__ADU76771

SEQ ID NO: 36809 - RNA, 1701 nt, Artificial Sequence
  hemagglutinin__InfluenzaA__ADU76772
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugaggggucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36810 - RNA, 1701 nt, Artificial Sequence; identical to SEQ ID NO: 36795
  hemagglutinin__InfluenzaA__ADU76774

SEQ ID NO: 36811 - RNA, 1701 nt, Artificial Sequence; identical to SEQ ID NO: 36795
  hemagglutinin__InfluenzaA__ADU76775

SEQ ID NO: 36812 - RNA, 1701 nt, Artificial Sequence; identical to SEQ ID NO: 36795
  hemagglutinin__InfluenzaA__ADU76776

SEQ ID NO: 36813 - RNA, 1701 nt, Artificial Sequence
  hemagglutinin__InfluenzaA__ADU76777
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggggauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36814 - RNA, 1701 nt, Artificial Sequence; identical to SEQ ID NO: 36813
  hemagglutinin__InfluenzaA__ADU76778

SEQ ID NO: 36815 - RNA, 1701 nt, Artificial Sequence
  hemagglutinin__InfluenzaA__ADU76779
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugaaucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36816 - RNA, 1701 nt, Artificial Sequence; identical to SEQ ID NO: 33206
  hemagglutinin__InfluenzaA__ADU76780

SEQ ID NO: 36817 - RNA, 1701 nt, Artificial Sequence
  hemagglutinin__InfluenzaA__ADU76781
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaagggaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuaccccaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36818 - RNA, 1701 nt, Artificial Sequence; identical to SEQ ID NO: 36799
  hemagglutinin__InfluenzaA__ADU76782

SEQ ID NO: 36819 - RNA, 1701 nt, Artificial Sequence
  hemagglutinin__InfluenzaA__ADU76784
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucaaacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcaugcccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36820 - RNA, 1701 nt, Artificial Sequence; identical to SEQ ID NO: 36795
  hemagglutinin__InfluenzaA__ADU76785

SEQ ID NO: 36821 - RNA, 1701 nt, Artificial Sequence; identical to SEQ ID NO: 36795
  hemagglutinin__InfluenzaA__ADU76786

SEQ ID NO: 36822 - RNA, 1701 nt, Artificial Sequence
  hemagglutinin__InfluenzaA__ADU76787
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauucgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36823 - RNA, 1701 nt, Artificial Sequence
  hemagglutinin__InfluenzaA__ADU76788
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacggcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacuggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36824 - RNA, 1701 nt, Artificial Sequence
  hemagglutinin__InfluenzaA__ADU76789
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacuggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36825 - RNA, 1701 nt, Artificial Sequence
  hemagglutinin__InfluenzaA__ADU76790
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaguucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36826 - RNA, 1701 nt, Artificial Sequence; identical to SEQ ID NO: 36800
  hemagglutinin__InfluenzaA__ADU76791

SEQ ID NO: 36827 - RNA, 1701 nt, Artificial Sequence
  hemagglutinin__InfluenzaA__ADU76792
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuacuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacuggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36828 - RNA, 1701 nt, Artificial Sequence
  hemagglutinin__InfluenzaA__ADU76793
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaaaguuugagauauuccccaagacaaguucauggcccaaucaugacucgaacaaagguguaacagcagcauguccucaugcuggaacaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccaugauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36829 - RNA, 1701 nt, Artificial Sequence
  hemagglutinin__InfluenzaA__ADU85911
augaaggcaauaauaguagucuugcuauauacauuugcaacugcagaugcugacacauuauguauaggcuaucaugcaaauaauucaacugacacuguugacacaguacuagaaaagaauguaacaguaacacacucuguuaaccuucuagaaaacaagcauaacgggaaacuauguaaacuaggagggauagccccauugcauuuagguaaaugugacauugcuggauggcucuugggaaacccagagugugaaucacuauucacagcaagcucaugguccuacauaguggaaacgccuaauucagacaaugggacauguuacccaggagauuucaucaauuaugaggaacuaagagagcauuugagcucugugucgucauuugaaagguuugaaauauuccccaaggcaaauucauggcccaaucaugauacgaauaagggggugacggcagcauguccuuaugcuggagcaaacagcuuuuacagaaauuuaauauggcuaguaaaaaaaggaaauucauacccaaagcucagcaaauccuacauuaacaauaagaagaaggaaguccucgugauauggggcauccaccauccaccuaccaguacugaccaacaaacucucuaccagaaugcagaugccuauguuuuuguggggucaucaaaauacagcaaaagauucaagccagaaauagcagcaagacccaaggugagggaucaagcaggaagaauggacuauuacuggacacuaauagaaccuggagacacaauaacauucgaagcaacuggaaaucuagugguaccaagauaugccuucgcaaugaaaagaggcucuggaucugguauuaucguuucagaugcaccaguccacgauuguaauacgacuugucaaacacccaaaggugcuauaaacaccagccuuccauuucagaauauacauccagucacaauuggagaauguccaaaauaugucaaaagcacaaaguugaggauggcuacaggauuaagaaauaucccgucuauucaaucaagaggccuauuuggggccauugcuggcuuccuugaagggggguggacaggaaugauagauggaugguacgguuaccaccaucaaaaugagcagggaucaggauaugcagccgaccaaaagagcacacagaaugccauugacgggaucacuaacaagguaaauucuaucauugaaaagaugaacacacaauucacagcaguggguaaagaauucagccaauuggaaaaaagaauagagaguuuaaacaauaagguugaugauggguucuuagauauuuggacuuacaaugccgaacugcugguccuauuggaaaaugaaagaacucuagauuaucacgauucaaaugugaagaaccuauaugaaaaaguaagaagccagcuaaaaaacaaugccaaagaaauuggaaauggcugcuuugaauuuuaccacaaaugcgauaacacgugcauggagagugucaaaaaugggacuuaugauuacccaaaauacucagaagaagcaaagcuaaacagagaggagauagaugggguaaagcuggaaucagcaaggauuuaccagauuuuggcgaucuauucaacugucgccagcucauuggugcuguuagucucucugggggcaaucaguuucuggaugugcuccaaugggucuuuacagugcagaauaugcaucuga

SEQ ID NO: 36830 - RNA, 1701 nt, Artificial Sequence
  hemagglutinin__InfluenzaA__ADV17283
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaucauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuugaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36831 - RNA, 1701 nt, Artificial Sequence; identical to SEQ ID NO: 34337
  hemagglutinin__InfluenzaA__ADV17293

SEQ ID NO: 36832 - RNA, 1701 nt, Artificial Sequence
  hemagglutinin__InfluenzaA__ADV17303
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaauuuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccaaaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36833 - RNA, 1701 nt, Artificial Sequence; identical to SEQ ID NO: 36830
  hemagglutinin__InfluenzaA__ADV17313

SEQ ID NO: 36834 - RNA, 1701 nt, Artificial Sequence
  hemagglutinin__InfluenzaA__ADV17323
augaaggcaauacuaguaguucugcuauauacauuugcaaccacaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaacccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaauucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaggucucuaucagaaugcagaugcauauguuuuuguggggacaucaagauauagcaagaaguucaagccggaaauagcaauaagacccaaagugagggaucaagaagggagaaugaacuacuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauuauguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuaccccaaauacucagaggaagcaaaauuaaacagagaagaaauagauggggugaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36835 - RNA, 1701 nt, Artificial Sequence
  hemagglutinin__InfluenzaA__ADV17333
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaauuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagaacaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaaaucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguacugagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuacuacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggugaucuauucaacugucgccaguucauugguacugguagucucccugggggcaaucaguuucuggaugugcucuaaugggucucuacaguguagaauauguauuuaa

SEQ ID NO: 36836 - RNA, 1701 nt, Artificial Sequence; identical to SEQ ID NO: 33173
  hemagglutinin__InfluenzaA__ADV19019

SEQ ID NO: 36837 - RNA, 1701 nt, Artificial Sequence
  hemagglutinin__InfluenzaA__ADV41677
augaaggcaauacuaguaguucugcuauauacauuugcaaccgcaaaugcagacacauuauguauagguuaucaugcaaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaaucauacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucgagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaucuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36838 - RNA, 1701 nt, Artificial Sequence
  hemagglutinin__InfluenzaA__ADV58939
augaaggcaauacuaguaguucugcuauauacauuugcaaccgcaaaugcagacacauuauguauagguuaccaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugauucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugagacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 36839 - RNA, 1698 nt, Artificial Sequence
  hemagglutinin__InfluenzaA__ADV69074
augaaaguaaaacuacugguucuguuauguacauuuacagcuacauaugcagacacaauauguauaggcuaucaugccaacaacucaaccgacacuguugacacaguacuugagaagaacgugacaguaacacacucugucaaccuacuugaggacagucacaauggaaaauuaugucuacuaaaaggaauagcuccacuacaauuggguaauugcaacguugccggauggaucuuaggaaacccagagugcgaauugcugauuuccaaggaaucauggucuuacauuguagaaacaccagauccugagaauggaacauguuacccaggguauuucaccgauuaugaagaacugagggagcaauugaguucaguaucuucauuuaagagguuugaaauauuccccaaagagagcucauggcccaaccacaccguaaccggaguaucagcaucaugcucccauaacgggaaaagcagcuuuuacagaaauuugcuauggcugacggugaaaaacgguuuguacccaaaccugagcaaauccuauacaaacgacaaagagaaagaaguccuuguacuaugggguguucaucacccaccuagcauaggggaccaaaggacccucuaucacacagaaaaugcuuaugucucuguagugucuucacauuauaguagaagauucaccccagagauagucaaaagacccaaggugagagaucaggaaggaagaaucaacuacuacuggacucugcuggaacccggggauacaauaauaugugaggcaaauggaaaucuaauagcgccaagguaugcuuucgcacugaguagaggcuuaggaucaggaaucaucaccucaaaugcaccaaugggugaauguaaugcaaagugucaaacaccucagggagcuauaaacagcagucucccuuuccagaauguacacccagucacaauaggagaguguccaaaguaugucaagagugcaaaacugagaaugguuacaggacuaaggaacaccccauccauucaauccagagguuuguuuggagccauugccgguuucauugaaggaggguggacuggaaugguagaugguugguaugguuaucaucaucagaaugagcaaggaucuggauaugcugcagaucaaaaaagcacacaaaaugccauuaaugggaucacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaaugcagaauuguuaguucuacuggaaaaugaaaggacuuuggauuuccaugacuccaacgugaagaaucuguaugagaaaguaaaaagccaguuaaagaauaaugccaaagaaauaggaaacggguguuuugaauucuaucauaaguguaacgaugaaugcauggagagugugaaaaauggaacuuaugacuauccaaaauauuccgaagagucaaagcuaaacagggagaaaauugauggagugaaauuggaaucaauggaagucuaucagauccuggcgaucuacucaacagucgccaguucucuagucuuuuuagucgcccugggggcaaucugcuucuggauguguuccaaugggucuuugcaguguaaaauaugcaucuaa

SEQ ID NO: 36840 - RNA, 1698 nt, Artificial Sequence
  hemagglutinin__InfluenzaA__ADV69075
augaaaguaaaacuacugguucuguuauguacauuuacagcuacauaugcagacacaauauguauaggcuaucaugccaacaacucaaccgacacuguugacacaguacuugagaagaacgugacaguaacacacucugucaaccuacuugaggacagucacaauggaaaauuaugucuacuaaaaggaauagcuccacuacaauuggguaauugcaacguugccggauggaucuuaggaaacccagagugcgaauugcugauuuccaaggaaucauggucuuacauuguagaaacaccagauccugagaauggaacauguuacccaggguaugucaccgauuaugaagaacugagggagcaauugaguucaguaucuucauuuaagagguuugaaauauuccccaaagagagcucauggcccaaccacaccguaaccggaguaucagcaucaugcucccauaacgggaaaagcagcuuuuacagaaauuugcuauggcugacggugaaaaacgguuuguacccaaaccugagcaaauccuauacaaacgacaaagagaaagaaguccuuguacuaugggguguucaucacccaccuagcauaggggaccaaaggacccucuaucacacagaaaaugcuuaugucucuguagugucuucacauuauaguagaagauucaccccagagauagucaaaagacccaaggugagagaucaggaaggaagaaucaacuacuacuggacucugcuggaacccggggauacaauaauaugugaggcaaauggaaaucuaauagcgccaagguaugcuuucgcacugaguagaggcuuuggaucaggaaucaucaccucaaaugcaccaaugggugaauguaaugcaaagugucaaacaccucagggagcuauaaacagcagucucccuuuccagaauguacacccagucacaauaggagaguguccaaaguaugucaagagugcaaaacugagaaugguuacaggacuaaggaacaccccauccauucaauccagagguuuguuuggagccauugccgguuucauugaaggaggguggacuggaaugguagaugguugguaugguuaucaucaucccaaugagcaaggaucuggauaugcugcagaucaaaaaagcacacaaaaugccauuaaugggaucacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaaugcagaauuguuaguucuacuggaaaaugaaaggacuuuggauuuccaugacuccaacgugaagaaucuguaugagaaaguaaaaagccaguuaaagaauaaggucaaagaaauaggaaacggguguuuugaauucuaucauaaguguaacgaugaaugcauggagagugugaaaaauggaacuuaugacuauccaaaauauuccgaagagucaaagcuaaacagggagaaaauugauggagugaaauuggaaucaauggaagucuaucagauccuggcgaucuacucaacagucgccaguucucuagucuuuuuagucgcccugggggcaaucugcuucuggauguguuccaaugggucuuugcaguguaaaauaugcaucuaa

SEQ ID NO: 36841 - RNA, 1698 nt, Artificial Sequence
  hemagglutinin__InfluenzaA__ADV69077
augaaaguaaaacuacugguucuguuauguacauuuacagcuacauaugcagacacaauauguauaggcuaucaugccaacaacucaaccgacacuguugacacaguacuugagaagaacgugacaguaacacacucugucaaccuacuugaggacagucacaauggaaaauuaugucuacuaaaaggaauagcuccacuacaauuggguaauugcaacguugccggauggaucuuaggaaacccagagugcgaauugcugauuuccaaggaaucauggucuuacauuguagaaacaccagauccugagaauggaacauguuacccaggguauuucaccgauuaugaagaacugagggagcaauugaguucaguaucuucauuuaagagguuugaaauauuccccaaagagagcucauggcccaaccacaccguaaccggaguaucagcaucaugcucccauaacgggaaaagcagcuuuuacagaaauuugcuauggcugacggugaaaaacgguuuguacccaaaccugagcaaauccuauacaaacgacaaagagaaagaaguccuuguacuaugggguguucaucacccaccuagcauaggggaccaaaggacccucuaucacacagaaaaugcuuaugucucuguagugucuucacauuauaguagaagauucaccccagagauagucaaaagacccaaggugagagaucaggaaggaagaaucaacuacuacuggacucugcuggaacccggggauacaauaauauuugaggcaaauggaaaucuaauagcgccaagguaugcuuucgcacugaguagaggcuuuggaucaggaaucaucaccucaaaugcaccaaugggugaauguaaugcaaagugucaaacaccucagggagcuauaaacagcagucucccuuuccagaauguacacccagucacaauaggagaguguccaaaguaugucaagagugcaaaacugagaaugguuacaggacuaaggaacaccccauccauucaauccagagguuuguuuggagccauugccgguuucauugaaggaggguggacuggaaugguagaugguugguaugguuaucaucaucagaaugagcaaggaucuggauaugcugcagaucaaaaaagcacacaaaaugccauuaaugggaucacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaaugcagaauuguuaguucuacuggaaaaugaaaggacuuuggauuuccaugacuccaacgugaagaaucuguaugagaaaguaaaaagccaguuaaagaauaaugccaaagaaauaggaaacggguguuuugaauucuaucauaaguguaacgaugaaugcauggagagugugaaaaauggaacuuaugacuauccaaaauauuccgaagagucaaagcuaaacagggagaaaauugauggagugaaauuggaaucaauggaagucuaucagauccuggcgaucuacucaacagucgccaguucucuagucuuuuuagucgcccugggggcaaucugcuucuggauguguuccaaugggucuuugcaguguaaaauaugcaucuaa

SEQ ID NO: 36842 - RNA, 1698 nt, Artificial Sequence
  hemagglutinin__InfluenzaA__ADV69078
augaaaguaaaacuacugauccuguuaugcacauuuacagcuacauaugcggacacaauauguauaggauaccaugccaacaacucaaccgacacuguugacacaguacuugaaaagaaugugacaguaacacacucugucaaccuacuugaggacagucacaaugggaagcugugccuacuaaagggaauagccccccuacaauuggguaauugcagcguugccggauggauauuaggaaacccagaaugcgaaucacugauuuccaagaaaucaugguccuacauuguagaaacaccaaauccugagaauggagcauguuacccaggggaguucgccgacuaugaggagcuaagggagcaauugaguucaguaucuucauuugagagauucgaaauauuccccaaagaaagcucauggcccaaccacacugcagccggagugucagcaucaugcucccauaauggggaaaaaaguuuuuacagaaaucugauauggcugacaaagaaaaaugguuuguacccaaaccugagcaaguccuaugaaaacgacaaagagaaagaaguccuuauacuaugggguguucaucauccgccuaacauagagaaccaaaggacccucuaucgcacagaaaaugcuuaugucucuguagugucuucacauuauagcggaagguucaccccagaaauaaccaaaaggcccaaaguaagaaaucaggaagggagaaucaacuacuacuggacucugcuggaacccggggauacaauaauauuugaggcaaauggaaaucuaauagcgccaugguaugcuuucacacugaguagaggccuuggaucaggaaucaucaccucuaaugcaccaauggacgaaugugaugcaaagugucaaacaccucagggagcuauaaacagcagucuuccuuuccagaauguacacccagucacaauaggagaauguccaaaguaugucaggagcucuaaauuaaggaugguuacaggacuaaggaacaucccauccauucaauccagagguuuguuuggggccauugccgguuucauugaagggggguggacuggaaugguagaugggugguaugguuaucaucaucagaaugagcagggaucuggcuaugcugcagaucaagaaagcacacaaaaugccauuaacgggauuacaaacaaggugaauucuguaauugagaaaaugaauacucaauucacagcugugggcaaggaauucaacaaauuggaaagaaggauggaaaacuuaaauaaaaagguugaugauggguuucuagacauuuggacauacaaugcagaguuguugguucuacuggaaaaugaaagaacuuuggacuuccacgacuccaaugugaagagucuguacgagaaaguaaaaagccaauuaaagaauaaugcuaaagaaauagggaaugggugcuuugaauucuaucacaaguguaacaacgaaugcauggagagugugaaaaauggaacuuaugacuauccaaaauauuccgaagaaucaaaguuaaacagggaaaaaauugauggaguuaaauuggacucaaugggggucuaucggauucuggcgaucuacucaacugucgccaguucccuaguucuuuuggucucccugggggcaaucagcuucuggauguguuccaaugggucuuugcaauguagaauaugcaucuaa

SEQ ID NO: 36843 - RNA, 1698 nt, Artificial Sequence
  hemagglutinin__InfluenzaA__ADV69079
augaaaguaaaacuacugauccuguuauguacauuuacagcuacauaugcggacacaauauguauaggcuaccaugccaacaacucaaccgacacaguugacacaguacuugagaagaaugugacaguuacacacucugucaaccuacuugaggacagucacaauggaaagcugugccuacuaaagggaauagccccccuacaauuggguaauugcagcguugccggauggaucuuaggaaacccagaaugcgaguuacugauuuccaagaaaucaugguccuacauuguaaaaacaccaaauccugaaaauggaucauguuacccaggguauuucgccgacuaugaggagcuaagggagcaauugaguucaguaucuucauuugagagauucgaaauguuccccaaagaaagcucauggcccaaccacaacguaaacggaguaucagcaucaugcucccauaaugggaaaagaaguuuuuacagaaaucugcuauggcugacgggaaaaaaugguuuguauccaaaccugaccaaguccuaugaaaacaacaaugagaaagagguccuuauacuaugggguguucaucacccgucuaauauaggggaccaaaggacccucuaucacacagaaaaugcuuaugucucuguaaugucuucacauuauagcagaagauucaccccagaaauaaacaaaaggcccaaaguaagagaucaggaaggaagaaucaacuauuacuggacucugcuagaacccggggauacaauaauauuugaggcaaaugggaaucuaauagcgccaugguaugcuuucgcacugaguagaggcuuuggaucaggaaucaucaccucaagugcaccaauggaugaaugugaugcgaagugucaaacaccucggggagcuauaaacagcagucuuccuuuccagaauguacacccagucacaauaggagaauguccaaaguaugucaggagugcaaaauuaaggaugguuacaggacuuaggaacaucccauccauucaauccagagguuuguuuggggccauugccgguuucauugaagggggguggacuggaaugguagaugggugguaugguuaccaucaucagaaugagcaaggaucuggcuaugcugcagaucaagaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaaugcagaguuguugguucuacuggaaaaugaaagaacuuuggauuuccacgacuccaaugugaagagucuguacgagaaaguaaaaagccaauuaaagaauaaugccaaagaaauaggaaaugggugcuuugaauucuaucacaaguguaacaacgaaugcauggagagugugaaaaauggaacuuaugacuauccaaaauauuccgaagaaucaaaguuaaacagggaaaaaauugauggagugaaauuggacucaaugggggucuaucagauucuggcgaucuacucaacugucgccaguucccugguucuuuuggucucccugggggcaaucagcuucuggauguguuccaaugggucuuugcaauguagaauaugcaucuaa

SEQ ID NO: 36844 - RNA, 1698 nt, Artificial Sequence
  hemagglutinin__InfluenzaA__ADV69080
augaaaguaaaacuacugauccuguuauguacauuuacagcuacauaugcggacacaauauguauaggauaccaugccaacaacucaaccgacacuguugacacaguacuugaaaagaaugugacagugacacacucugucaaccuacuugaggacagucacaaugggaagcugugccuacuaaagggaauagccccccuacaauuggguaauugcagcguugccggauggauauuaggaaauccagaaugcgaaucacugauuuccaagaaaucaugguccuacauuguagaaacaccaaauccugagaauggagcauguuacccaggggaguucgccgacuaugaggagcuaagggagcaauugaguucaguaucuucauuugagagauucgaaauauuccccaaagaaagcucauggcccaaccacacugcagccggagugucagcaucaugcucccacaauggggaaagaaguuuuuacagaaaucugauauggcugacaaugaaaaaugguuuguacccaaaccugagaaaguccuaugaaaacgacaaagagaaagaaguccuuauacuaugggguguccaucauccgccuaacauagagaaccaaaggacccucuaucacacagaaaaugcuuaugucucuguagugucuucacauuauagcggaagauucaccccagaaauaaccaaaaggcccaaaguaagagaucaggaaggaagaaucaacuacuacuggacucuucuggaacccggggauacaauaauauuugaggcaaauggaaaucuaauagcgccaugguaugcuuucacacugaguagaggccuuggaucaggaaucaucaccucuaaugcaccaauggacgcaugugaugcaaagugucaaacaccucagggagcuauaaacagcagucuuccuuuccagaauguacacccagucacaauaggagaauguccaaaguaugucaggagugcaaaauuaaggaugguuacaggacuaaggaacaucccauccauucaauccagagguuuguuuggggccauugccgguuucauugaagggggguggacuggaaugguagaugggugguaugguuaucaucaucagaaugagcagggaucuggcuaugcugcagaucaagaaagcacacaaaaugccauuaacgggauuacaaacaaggugaauucuguaauugagaaaaugaacacucaauucacagcugugggcaaggaauucaacaaauuggaaagaaggauagaaaacuuaaauaaaaagguugaugauggguuuauagacauuuggacuuacaaugcagaguuguugguucuacuggaaaaugaaagaacuuuggacuuccacgacuccaaugugaagagucuguacgagaaaguaaaaagccaauuaaagaauaaugcuaaagaaauagggaaugggugcuuugaauucuaucacaaguguaacaacgaaugcauggagagugugaaaaauggaacuuaugacuauccaaaauauuccgaagaaucaaaguuaaacagggaaaaaauugauggaguuaaauuggacucaaugggggucuaucggauucuggcgaucuacucaacugucgccaguucccuaguucuuuuggucucccugggggcaaucagcuucuggauguguuccaaugggucuuugcaauguagaauaugcaucuag

SEQ ID NO: 36845 - RNA, 1698 nt, Artificial Sequence
  hemagglutinin__InfluenzaA__ADV69081
augaaaguaaaacuacugguucuguuauguacauuuacagcuacauaugcagacacaauauguauaggcuaucaugccaacaacucaaccgacacuguugacacaguacuugagaagaacgugacaguaacacacucugucaaccuacuugaggacagucacaauggaaaauuaugucuacuaaaaggaauagcuccacuacaauuggguaauugcaacguugccggauggaucuuaggaaacccagagugcgaauugcugauuuccaaggaaucauggucuuacauuguagaaacaccaaauccugagaauggaacauguuacccaggguauuucaccgauuaugaagaacugagggagcaauugaguucaguaucuucauuuaagagguuugaaauauuccccaaagagagcucauggcccaaccacaccguaaccggaguaucagcaucaugcucccauaacggggaaagcagcuuuuacagaaauuugcuauggcugacggugaaaaacgguuuguacccaaaacugagcaaauccuauacaaacgacaaagagaaagaaguccuuguacuaugggguguucaucacccgccuaacauaagggaccaaaggacccucuaucauacagaaaaugcuuaugucucuguagugucuucacauuauaguagaagauucaccccagaaauagucaaaagacccaaggugagagaucaggaaggaagaaucaacuacuacuggacucugcuggaacccggggauacaauaauauuugaggcaaauggaaaucuaauagcgccaagguaugcuuucgcacugaguagaggcuuuggaucaggaaucaucaccucaaaugcaccaaugggugaguguaaugcaaagugucaaacaccucagggagcuauaaucagcagucugccuuuccagaauguacacccagucacaauaggagaguguccaaaguaugucaagagugcaaaacugaggaugguuacaggacuaaggaacaccccauccauucaauccagagguuuguuuggggcuauugccgguuucauugaaggaggguggacuggaaugguagaugguugguaugguuaucaucaucagaaugagcaaggaucuggauaugcugcagaucaaaaaagcacacaaaaugccauuaaugggaucacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaaugcagaauuguuaguucuacuggaaaaugaaaggacuuuggauuuccaugacuccaacgugaagaaucuguaugagaaaguaaaaagccaauuaaagaauaaugccaaagaaauaggaaacggguguuuugaauucuaucauaaguguaacgaugaaugcauggagagugugaaaaauggaacuuaugacuauccaaaauauuccgaagagucaaagcuaaacagggagaaaauugauggagugaaauuggaaucaauggaagucuaucagauccuggcgaucuacucaacagucgccaguucucuagucuuuuuagucgcccugggggcaaucugcuucuggauguguuccaaugggucuuugcaguguaaaauaugcaucuaa

SEQ ID NO: 36846 - RNA, 1698 nt, Artificial Sequence
  hemagglutinin__InfluenzaA__ADV69083
augaaaguaaaacuaaugguucuguuauguacauuuacagcuacauaugcagacacaauauguguaggcuaccaugccaacaacucaacugacacuguugacacaguacuugagaagaaugugacagugacacacucugucaaccuacuugaggacagccacaauggaaaacuaugucuacuaaaaggaauagcuccacuacaauuggguaguugcagcguugccggauggaucuuaggaaacccagagugcgaauugcugauuuccaaggaaucaugguccuacauuguagaaacaccaaauccugagaauggaacauguuacccaggguauuucacagacuaugaagaacugagggagcaauugaguucaguaucuucauuuaagagguucgaaauauuccccaaagagagcucauggcccaaccacaacguaaccggaguaucaucaucaugcucccauaacgggaaaagcagcuucuacagaaauuugcuauggcugacggugaagaacggucuguacccaaaccugagcaaguccuauacaaacaaaaaggagaaagaaguccuuguacuaugggguguucaucacccaucuaacauaggggaccaaagggcccucuaucauacagaaaaugcuuaugucucuguagugucuucacauuauagcagaagauucaccccagaaauagccaaaagacccaaggugagaaaucaggaaggaagaaucaacuacuacuggacccugcuagaacccggggauacaauaauauuagaggcaaauggaaaucuaauagcaccaagguaugccuucgaacugaguaaggguuugggaucaggaaucaucacaucaaaugcaccaaugggugaauguaaugcaaagugucaaacaccucagggagcuauaaacagcagucuuccuuuccagaauguacacccaguaacaauaggagaguguccaaaguaugucaaaagugcaaaauuaaggaugguuacaggacuaaggaacaccccauccauucaauccagagguuuguuuggagccauugccgguuucauugaaggaggguggacuggaaugguagaugguugguaugguuaucaccaucagaaugagcaaggaucuggguaugcugcagaccaacaaagcacacaaaaugccauuaaugggauuacaaacaaggugaauucugugauugaaaaaaugaacacucaauucacagcugugggcaaagaauucaacaaacuggaaagaagaauggaaaacuuaaauaaaaagguugaugauggguuucuagacauuuggacauauaaugcagaauuguuaguucuacuggaaaaugaaaggacuuuggauuuccaugacuccaacgugaagaaucuguaugagaaaguaaaaagccaauuaaaaaauaaugccaaagaaauaggaaacggguguuuugaauucuaucauaaguguaacgaugaaugcauggagagugugaaaaauggaacuuaugacuauccaaaauauuccgaagaaucaaaguuaaacagggagaaaauugauggagugaaauuggaaucaaugggagucuauaauauccuggcgaucuacucaacagucgccaguucccuaguucuuuuagucucccugggggcaaucagcuucuggauguguuccaaugggucuuuacaguguagaauaugcaucuaa

SEQ ID NO: 36847 - RNA, 1698 nt, Artificial Sequence
  hemagglutinin__InfluenzaA__ADV69084
augaaaguaaaacuaaugguucuguuauguacauuuacagcuacauaugcagacacaauauguguaggauaccaugccaacaacucaacugacacuguugacacaguacuugagaagaaugugacagugacacacucugucaaccuacuugaggacagccacaauggaaaacuaugucuacuaaaaggaauagcuccacuacaauuggguaguugcagcguugccggauggaucuuaggaaacccagagugcgaauugcugauuuccaaggaaucaugguccuacauuguagaaacaccaaauccugagaauggaacauguuacccaggguauuucacagacuaugaagaacugagggaacaauugaguucaguaucuucauuuaagagguucgaaauauuccccaaagagagcucauggcccaaucacaacguaaccggagugucaucaucaugcucccauaacgggaaaagcagcuucuacagaaauuugcuauggcugacggugaagaacgguuuguacccaaaccugagcaaguccuauacaaacaaaaaggagaaagaaguucuuauacuaugggguguucaucacccaucuaacauaagggaccaaagggcccucuauuauacagaaaaugcuuaugucucuguagugucuucacauuauagcagaagauucaccccagaaauagccaaaagacccaaggugagaaaucaggaaggaagaaucaacuacuacuggacucugcuagaacccggggauacaauaauauuugaggcaaauggaaaucuaauagcaccaagguaugccuucgaauugaguaaggguuuuggaucagggaucaucacaucagacgcaccaaugggugaauguaaugcaaagugucaaacaccucagggagcuauaaacagcagucuuccuuuccagaauguacacccaguaacaauaggagaguguccaaaguaugucaggagugcaaaauuaaggaugguuacaggacuaaggaacaccccauccauucaauccagagguuuguuuggagccauugccgguuucauugaaggaggguggacuggaaugguagaugguugguaugguuaucaucaucagaaugagcaaggaucuggguaugcugcagaccaacaaagcacacaaaaugccauuaaugggauuacaaacaaggugaauucuguaauugaaaaaaugaacacucaauucacagcugugggcaaagaauucaacaaauuggaaagaagaauggaaaacuuaaauaaaaagauugaugauggguuucuagacauuuggacauauaaugcagaauuguuaguuuuacuggaaaaugaaaggacuuuggauuuccaugacuccaacgugaagaaucuguaugagaaaguaaaaagccaauuaaaaaauaaugccaaagaaauaggaaacggguguuuugaauucuaucauaaguguaacgaugaaugcauggagagugugaaaaauggaacuuaugacuauccaaaauauuccgaagaaucaaaguuaaacagggagaaaauugauggagugaaauuggaaucaaugggagucuauaauauccuggcgaucuacucaacagucgccaguucccuaguucuuuuagucucccugggggcaaucagcuucuggauguguuccaaugggucuuuacaguguagaauaugcaucuaa

SEQ ID NO: 36848 - RNA, 1698 nt, Artificial Sequence
  hemagglutinin__InfluenzaA__ADV69085
augaaaguaaaacuaaugguucuguuauguacauuuacagcuacauaugcagacacaauauguguaggcuaccaugccaacaacucaacugacacuguugacacaguacuugagaagaaugugacaguaacacacucugucaaccuacuugaggacagccacaauggaaaacuaugucuacuaaaaggaauagcuccacuacaauuggguaguugcagcguugccggauggaucuuaggaaacccagagugcgaauugcugauuuccaaggaaucaugguccuacauuguagaaacaccaaauccugagaauggaacauguuacccaggguauuucacagacuaugaagaacugagggagcaauugaguucaguaucuucauuuaagagguucgaaauauuccccaaagagagcucauggcccaaccacaccguaaccggagugucaucaucaugcucccauaacgggaaaagcagcuucuacagaaauuugcuauggcugacgaugaagaacgguuuguacccaaaccugagcaaguccuauacaaacaaaaaggagaaagaaguccuuguacuaugggguguucaucacccaucuaacauaggggaccaaagggcccucuaucauacagaaaaugcuuaugucucuguagugucuucacauuauagcagaagauucaccccagaaauagccaaaagacccaaggugagaaaucaggaaggaagaaucaacuacuacuggacucugcuagaacccggggauacaauaauauuugaggcaaauggaaaucuaauagcaccaagguaugccuucgaacugaguaaggguuuuggaucaggaaucaucacaucaaaugcaccaaugggugaauguaaugcaaagugucaaacaccucagggagcuauaaacagcagucuuccuuuccagaauguacacccaguaacaauaggagaguguccaaaguaugucaggaguucaaaauuaaggaugguuacaggacuaaggaacaccccauccauucaauccagagguuuguuuggagccauugccgguuucauugaaggaggguggacuggaaugguagaugguugguaugguuaucaucaucagaaugagcaaggaucuggguaugcugcagaccaacaaagcacacaaaaugccauuaaugggauuacaaacaaggugaauucuguaauugaaaaaaugaacacucaauucacagcugugggcaaagaauucaacaaauuggaaagaagaauggaaaacuuaaauaaaaagauugaugauggguuucuagacauuuggacauauaaugcagaauuguuaguucuacuggaaaaugaaaggacuuuggauuuccaugacuccaacgugaagaaucuguaugagaaaguaaaaagccaauuaaaaaauaaugccaaagaaauaggaaacggguguuuugaauucuaucauaaguguaacgaugaaugcauggagagugugaaaaauggaacuuaugacuauccaaaauauuccgaagaaucaaaguuaaacagggagaaaauugauggagugaaauuggaaucaaugggagucuauaauauccuggcgaucuacucaacagucgccaguucccuaguucuuuuagucucccugggggcaaucagcuucuggauguguuccaaugggucuuuacaguguagaauaugcaucuaa

SEQ ID NO: 36849 - RNA, 1698 nt, Artificial Sequence
  hemagglutinin__InfluenzaA__ADV69086
augaaaguaaaacuacugguucuguuauguacauuuacagcuacauaugcagacacaauauguauaggcuaucaugccaacaacucaaccgacacuguugacacaguacuugagaagaaugugacaguaacacacucugucaaucuacuugaggacagucacaauggaaaauuaugucuacuaaaaggaauagcuccacuacaauuggguaauugcaacguugccggauggaucuuaggaaacccagagugcgaauugcugauuuccaaggaaucauggucuuacauuguagaaacaccaaacccugagaauggaacauguuacccaggguauuucaccgacuaugaagaacugagggaacaauugaguucaguaucuucauuuaagagguuugaaauauuccccaaagagagcucauggcccaaacacaccguaaccggagugucagcaucaugcucccauaacgggaaaagcagcuuuuacagaaauuugcuauggcuaacggggaagaacgguuuguacccaaaccugagcaaauccuauacaaacgacaaagaaaaagaaguccuuguauuaugggguguucaucacccgucaaacauaggggaccaaagggcccucuaucauaaagaaaaugcuuaugucucuguagugucuucacauuauagcagaagauucaccccagaaauagucaaaagacccaaggugagagaucaggaaggaagaaucaacuacuacuggacucugcuggaacccggggauacaauaauauuugaggcaaauggaaauuuaauagcgccaagguaugcuuucgcacugaguagaggcuuuggaucaggaaucaucaccucaaaugcaccaauggaugaauguaauacaaagugucaaacaccucagggagcuauaaacagcagccuuccuuuccagaauguacacccagucacaauaggagaguguccaaaauaugucaagagugcaaaauuaaggaugguuacaggacuaaggaacaccccauccauucaauccagagguuuguuuggagccauugccgguuucauugaaggaggguggacuggaaugguagaugguugguaugguuaucaucaucaaaaugagcaaggaucuggauaugcugcagaucaaaaaagcacacaaaaugccauuaaugggaucacaaacaaggugaauucuguaauugagaaaaugaacacucaauucacagcagugggcaaagaauucaacaaauuggaaagaaggauggaaaacuuaaauaaaaagguugaugauggguuucuagacauuuggacauauaaugcagaauuguuaguucuacuggaaaaugaaaggacuuuggauuuccacgacuccaacgugaaaaaucuguaugagaaaguaaaaagccaauuaaaaaauaaugccaaagaaauaggaaacgggugcuuugaauucuaucacaaguguaacgaugaaugcauggagagugugaaaaauggaacuuaugacuauccaaaauauuccgaagagucaaaguuaaacagggagaaaauugauggagugaaauuggaaucaauggaagucuaucagauccuggcgaucuacucaacagucgccaguucucuagucuuuuuagucucccugggggcaaucugcuucuggauguguuccaaugggucuuugcaguguagaauaugcaucuaa

SEQ ID NO: 36850 - RNA, 1698 nt, Artificial Sequence
  hemagglutinin__InfluenzaA__ADV69087
augaaaguaaaacuaaugguucuguuauguacauuuacagcuacauaugcagacacaauauguguaggcuaccaugccaacaacucaacugacacuguugacacaguacuugagaagaaugugacagugacacacucugucaaccuacuugaggacagccacaauggaaaacuaugucuacuaaaaggaauagcuccacuacaauuggguaguugcagcguugccggauggaucuuaggaaacccagaaugcgaauugcugauuuccaaggaaucaugguccuacauuguagaaacaccaaauccugagaauggaacauguuacccaggguauuucacagacuaugaagaacugagggagcaauugaguucaguaucuucauuuaagagguucgaaauauuccccaaagagagcucauggcccaaccacaccguaaacggagugucaucaucaugcucccauaacggggaaagcagcuucuacagaaauuugcuauggcugacggugaaggacgguuuguacccaaaccugagcaaguccuauacaaacaaaaaggagaaagaaguccuuguacuaugggguguucaucacccaucuaacauaggggaccaaagggcccucuaucauacagaaaaugcuuaugucucuguagugucuucacauuauagcagaagauucaccccagaaauagccaaaagacccaaggugagaaaucaggaaggaagaaucaacuacuacuggacucugcuagaacccggggauacaauaauauuugaggcaaauggaaaucuaauagcaccaagguaugccuucgaacugaguaaggguuuuggaucaggaaucaucacaucaaaugcaccaaugggugaauguaaugcaaagugucaaacaccucagggagcuauaaacagcagucucccuuuccagaauguacacccaguaacaauaggagaguguccaaaguaugucaggaguacaaaauuaaggaugguuacaggacuaaggaacaccccauccauucaauccagagguuuguuuggagccauugccgguuucauugaaggaggguggacuggaaugguagaugguugguaugguuaucaucaucagaaugagcaaggaucuggguaugcugcagaucaacaaagcacacaaaaugccauuaaugggauuacaaacaaggugaauucuguaauugaaaaaaugaacacucaauucacagcugugggcaaagaauucaacaaauuggaaagaagaauggaaaacuuaaauaaaaagauugaugauggguuucuagacauuuggacauauaaugcagaauuguuaguucuacuggaaaaugaaaggacuuuggauuuccaugacuccaacgugaagaaucuguaugagaaaguaaaaagccaauuaaaaaauaaugccaaagaaauaggaaacggguguuuugaauucuaucauaaguguaacgaugaaugcauggagagugugaaaaauggaacuuaugacuauccaaaauauuccgaagaaucaaaguuaaacagggagaaaauugauggagugaaauuggaaucaaugggagucuauaauauccuggcgaucuacucaacagucgccaguucccuaguucuuuuagucucccugggggcaaucagcuucuggauguguuccaaugggucuuuacaguguagaauaugcaucuaa

SEQ ID NO: 36851 - RNA, 1698 nt, Artificial Sequence
  hemagglutinin__InfluenzaA__ADV69088
augaaaguaaaacuacugauccuguuauguacauuuacagcuacauaugcggacacaauauguauaggcuaccaugccaacaacucaaccgacacaguugacacaguacuugagaagaaugugacaguuacacacucugucaaucuacuugaggacagucacaauggaaagcugugccuacuaaagggaauagccccucuacaauuggguaauugcagcguuaccggauggaucuuaggaaacccagaaugcgaauuacugauuuccaagaaaucaugguccuacauuguagaaacaccaaauccugagaauggagcauguuacccaggguauuucgccgacuaugaggagcuaagggagcaauugaguucaguaucuucauuugagagauucgaaauauuccccaaagaaagcucauggcccaaccacaacguaaacggaguaucagcaucaugcucccauaaugggaaaagcaguuuuuacagaaaucugcuauggcugacggggaaaaaugguuuguacccaagccugaccaaauccuaugcaaacgacaaagagaaagaaguccuuauacuaugggguguucaucacccgucuaacauaggggaccaaaggacccucuaucacacagaaaaugcuuaugucucuguaaugucuucacauuauagcagaagauucaccccagaaauauccaaaaggcccaaaguaagagaucaggaaggaagaaucaacuacuacuggacucugcuagaacccggggauacaauaauauuugaggcaaaugggaaucuaauagcgccaugguaugcuuucgcacugaguagaggcuuuggaucaggaaucaucaccucaagugcaccaauggaugcaugcgaugcgaagugucaaacaccucagggagcuauaaacagcagucuuccuuuccagaauguacacccagucacaauaggagaauguccaaaguaugucaggaguacaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaagaaagcacacaaaaugcccuucaugggauuacaaacaaggugaauucuguaauugagaaaaugaacacucaauucacagcugugggcaaagaauucaacaaauuggaaagaaggauggaaaacuugaauaaaaaaguugaugauggguuucuagacauuuggacauauaaugcagaguuguugguucuacuggaaaaugaaagaacuuuggauuuccacgacuccaaugugaagagucuguacgagaaaguaaaaauccaauuaaagaauaaugccaaagaaauaggaaaugggugcuuugaauucuaucacaaguguaacaaugaaugcauggagagugugagaaauggaacuuaugacuauccaaaauauuccgaagaaucaaaguuaaacagggaaaaaauugauggagugaaauuggacucaaugggggucuaucagauucuggcgaucuacucaacugucgccaguucccugguucuuuuggucucccugggggcaaucagcuucuggauguguuccaaugggucuuugcaauguagaauaugcaucuag

SEQ ID NO: 36852 - RNA, 1698 nt, Artificial Sequence
  hemagglutinin__InfluenzaA__ADV69089
augaaaguaaaacuacugauccuguuauguacauuuacagcuacauaugcggacacaauauguauaggcuaccaugccaacaacucaaccgacacaguugacacaguacuugagaagaaugugacaguuacacacucugucaaucuacuugaggacagucacaauggaaagcuuugccuacuaaagggaauagccccccuacaauuggguaauugcagcguugccggauggaucuuaggaaacccagagugcgaauuacugauuuccaagaaaucaugguccuacauuguagaaacaccaaauccugagaauggagcauguuacccaggguauuucgccgacuaugaggagcuaagggagcaauugaguucaguaucuucauuugagagauucgaaauauuccccaaagaaagcucauggcccaaccacaacguaaacggaguaucagcaucaugcucccauaaugggaaaagcaguuuuuacagaaaucugcuauggcugacggggaaaaaugguuuguacccaaaccugaccaaguccuaugcaaacaacaaagagaaagaaguccuuauacugugggguguucaucacccgucuaacauaggggaccaaaggacccucuaucacacagaaaaugcuuaugucucuguaaugucuucacacuauagcagaagauucaccccagaaauaaccaaaaggcccaaaauaagagaucaggaaggaagaaucaacuacuacuggacucugcuagaacccggggauacaauaauauaugaggcaaaugggaaucuaauagcgccaugguaugcuuucgcacugaguagaggcuuuggaucaggaaucaucaccucaagugcaccaauggaugaaugugaugcgaagugucaaacaccucagggagcuauaaacagcagucuuccuuuccagaauguacacccagucacaauaggagaauguccaaaguaugucaggagugcaaaauuaaggaugguuacaggacuaaggaacaucccauccauucaauccagagguuuguuuggagccauugccgguuucauugaagggggguggacuggaaugguaaaugggugguaugguuaucgucuucacaaugaccaaggaucuggcuaugcugcagaucaaaaaagcacacaaaacgcccuuaacgggauuacaaacaaggugaauucuguaauugagaaaaugaacacucaauucacagcugugggcaaggaauucaacaaauuggaaagaagaauggaaaacuuaaauaaaaaaguugaugauggguuucuagacauuuggacauauaaugcagagauguugguucuacuggaaaaugaaagaacuuuggauuuccacgacuccaaugugaagagucuauacgagagaguaaaaauucaauuaaagaauaaugccaaagaaauaggaaaugggugcuuugaauucuaucacaaguguaacaaugaaugcauggagagugugagaaauggaacuuaugacuauccaaaauauuccgaagaaucaaaauuaaacagggaaaaaauugauggagugaaauuggacucaaugggggucuaucagauucuggcgaucuacucaacugucgccaguucccugguucuuuuggucucccugggggcaaucagcuucuggauguguuccaaugggucuuugcaauguagaauaugcaucuaa

SEQ ID NO: 36853 - RNA, 1698 nt, Artificial Sequence
  hemagglutinin__InfluenzaA__ADV69090
augaaaguaaaacuacugguucuguuauguacauuuacagcuacauaugcagacacaauauguauaggguaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaaucacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacgaggaagaaugguuuguauccaaaccugagcaaguccuaugcaaacaacaaagagaaagaaguccuuguacugugggguguucaucacccgccuaaccuaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggaaagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 36854 - RNA, 1698 nt, Artificial Sequence
  hemagglutinin__InfluenzaA__ADV69091
augaaaguaaaacuacugguucuguuauguacauuuacagcuacauaugcagacacaauauguauaggcuaucaugccaacaacucaaccgacacuguugacacaguacuugagaagaaugugacaguaacacacucugucaaccuacuugaggacagucacaauggaaaauuaugucuacuaaaaggaauagcuccacuacaauugggcaauugcaacguugccggauggaucuuaggaaacccagagugcgaauugcugauuuccaaggaaucauggucuuacauuguagaaacaccaaauccugagaauggaacauguuacccaggguauuucaccgacuaugaagaacugagggaacaauugaguucaguaucuucauuuaagagguuugaaauauuccccaaagaaagcucauggcccaaccacaccguaaccggaguaucagcaucaugcucccauaacgggaaaagcagcuuuuacagaaauuugcuauggcuaacgaggaagaacgguuuguacccaaaccugagcaaauccuauacaaacgacaaagagaaagaaguccuuguauuaugggguguucaucacccgucaaacauaggggaccaaagggcccucuaucauaaagaaaaugcuuaugucucuguagugucuucacauuauagcagaagauucaccccagaaauagucaaaagacccaaggugagagaucaggaaggaagaaucaacuauuacuggacucugcuggaacccggggauacaauaauauuugaggcaaauggaaauuuaauagcgccaagguaugcuuucgcacugaguagaggcuuuggaucaggaaucaucaccucaaaugcaccaauggaugaauguaauacaaagugucaaacaccucagggagcuauaaacagcagucuuccuuuccagaauguacacccagucacaauaggagaguguccaaaauaugucaagagugcaaaauuaaggaugguuacaggacuaaggaacaccccauccauucaauccagagguuuguuuggagccauugccgguuucauugaaggaggguggacuggaaugguagaugguugguaugguuaucaucaucagaaugagcaaggaucuggauaugcugcagaucaaaaaagcacacaaaaugccauuaaugggaucacaaacaaggugaauucuguaauugagaaaaugaacacucaauucacagcugugggcaaggaauucaacaaauuggaaagaaggauggaaaacuuaaauaaaaagguugaugauggguuucuagacauuuggacauauaaugcagaauuguuaguucuacuggaaaaugaaaggacuuuggauuuccaugacuccaacgugaaaaaucuguaugagaaaguaaaaaaccaauuaaagaauaaugccaaagaaauaggaaacgggugcuuugaauucuaucacaaguguaacgaugaaugcauggagagugugaaaaauggaacuuaugacuauccaaaauauuccgaagagucaaaguuaaacagggagaaaauugauggagugaaauuggaaucgauggaagucuaucagauccuggcgaucuacucaacagucgccaguucucuagucuuuuuagucucccugggggcaaucugcuucuggauguguuccaaugggucuuugcaguguagaauaugcaucuaa

SEQ ID NO: 36855 - RNA, 1698 nt, Artificial Sequence
  hemagglutinin__InfluenzaA__ADV69092
augaaaguaaaacuacugguucuguuauguacauuuacagcuacauaugcagacacaauauguauaggcuaucaugccaacaacucaaccgacacuguugacacaguacuugagaagaaugugacaguaacacacucugucaaccuacuugaggacagucacaauggaaaauuaugucuacuaaaaggaauagcuccacuacaauugggcaauugcaacguugccggauggaucuuaggaaacccagagugcgaauugcugauuuccaaggaaucauggucuuacauuguagaaacaccaaauccugagaauggaacauguuacccaggguauuucaccgacuaugaagaacugagggaacaauugaguucaguaucuucauuuaagagguuugaaauauuccccaaagagagcucauggcccaaccacaccguaaccggaguaucagcaucaugcucccauaacgggaaaagcagcuuuuacagaaauuugcuauggcuaacggggaagaacgguuuguacccaaaccugagcaaauccuauacaaacgacaaagagaaagaaguccuuguauuaugggguguucaucacccgucaaacauaggggaccaaagggcccucuaucauaaagaaaaugcuuaugucucuguagugucuucacauuauagcagaagauucaccccagaaauagucaaaagacccaaggugagagaucaggaaggaagaaucaacuacuacuggacucugcuggaacccggggauacaauaauauuugaggcaaauggaaauuuaauagcgccaagguaugcuuucgcacugaguagaggcuuuggaucaggaaucaucaccucaaaugcaccaauggaugaauguaauacaaagugucaaacaccucagggagcuauaaacagcagucuuccuuuccagaauguacacccagucacaauaggagaguguccaaaauaugucaagagugcaaaauuaaggaugguuacaggacuaaggaacacccuauccauucaauccaaagguuuguuuggagccauugccgguuucauugaaggaggguggacuggaaugguagaugguugguaugguuaucaucaucagaaugagcaaggaucuggauaugcugcagaucaaaaaagcacacaaaaugccauuaaugggaucacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaaugcagaauuguuaguucuacuggaaaaugaaaggacuuuggauuuccaugacuccaacgugaaaaaucuguaugagaaaguaaaaagccaauuaaagaauaaugccaaagaaauaggaaacgggugcuuugaauucuaucacaaguguaacgaugaaugcauggagagugugaaaaauggaacuuaugacuauccaaaauauuccgaagagucaaaguuaaacagggagaagauugauggagugaaauuggaaucgauggaagucuaucagauccuggcgaucuacucaacagucgccaguucucuagucuuuuuagucucccugggggcaaucugcuucuggauguguuccaaugggucuuugcaguguagaauaugcaucuaa

SEQ ID NO: 36856 - RNA, 1698 nt, Artificial Sequence
  hemagglutinin__InfluenzaA__ADV69093
augaaaguaaaacuaaugguucuguuauguacauuuacagcuacauaugcagacacaauauguguaggcuaccaugccaacaacucaacugacacuguugacacaguacuugagaagaaugugacagugacacacucugucaaccuacuugaggacagccacaauggaaaacuaugucuacuaaaagggauagcuccacuacaauuggguaguugcagcguugccggauggaucuuaggaaacccagagugcgaauugcugauuuccaaggaaucuugguccuacauuguagaaacaccaaauccugagaauggaacauguuacccaggguaugucacagacuaugaagaacugagggagcaauugaguucaguaucuucauuuaagagguucgaaauauuccccaaagagagcucauggcccaaccacaccguaaccggagugucaucaucaugcucccauaacgggaaaagcagcuucuacagaaauuugcuauggcugacggugaagaacggucuguacccaaaccugagcaaguccuauacaaacaaaaaggagaaagaaguccuuguacuaugggguguucaucacccaucuaacauaggggaccaaagggcccucuaucauacagaaaaugcuuaugucucuguagugucuucacauuauagcagaagauucaccccagaaauagccaaaagacccaaggugagaaaucaggaaggaagaaucaacuacuacuggacccugcuagaacccggggauacaauaauauuugaggcaaauggaaaucuaauagcaccaagguaugccuucgaacugaguaaggguuuuggaucaggaaucaucacaucaaaugcaccaaugggugaauguaaugcaaagugucaaacaccucagggagcuauaaacagcagucuuccuuuccagaauguacacccaguaacaauaggagaguguccaaaguaugucaaaagugcaaaauuaaggaugguuacaggacuaaggaacaccccauccauucaauccagagguuuguuuggagccauugccgguuucauugaaggaggguggacuggaaugguagaugguugguaugguuaucaccaucagaaugagcaaggaucuggguaugcugcagaccaacaaagcacacaaaaugccauuaaugggauuacaaacaaggugaauucuguaauugagaaaaugaacacucaauucacagcugugggcaaagaauucaacaaacuggaaagaagaauggaaaacuuaaauaaaaggguugaugauggguuucuagacauuuggacauauaaugcagaauuguuaguucuacuggaaaaugaaaggacuuuggauuuccaugacuccaacgugaagaaucuguaugagaaaguaaaaagccaauuaaaaaauaaugccaaagaaauaggaaacggguguuuugaauucuaucauaaguguaacgaugaaugcauggagagugugaaaaauggaacuuaugacuauccaaaauauuccgaagaaucaaaguuaaacagggagaaaauugauggagugaaauuggaaucaaugggagucuauaauauccuggcgaucuacucaacagucgccaguucccuaguucuuuuagucucccugggggcaaucagcuucuggauguguuccaaugggucuuuacaguguagaauaugcaucuaa

SEQ ID NO: 36857 - RNA, 1698 nt, Artificial Sequence
  hemagglutinin__InfluenzaA__ADV69094
augaaaguaaaacuaaugguucuguuauguacauuuacagcuacauaugcagacacaauauguguaggcuaccaugccaacaacucaacugacacuguugacacaguacuugagaagaaugugacagugacacacucugucaaccuacuugaggacagccacaauggaaaacuaugucuacuaaaaggaauagcuccacuacaauuggguaguugcagcguugccggauggaucuuaggaaacccagagugcgaauugcugauuuccaaggaaucuugguccuacauuguagaaacaccaaauccugagaauggaacauguuacccaggguauuucacagacuaugaagaacugagggagcaauugaguucaguaucuucauuuaagagguucgaaauauuccccaaagagagcucauggcccaaccacaccguaaccggagugucaucaucaugcucccauaacgggaaaagcagcuucuacagaaauuugcuauggcugacggugaagaacggucuguacccaaaccugagcaaguccuauacaaacaaaaaggagaaagaaguccuuguacuaugggguguucaucacccaucuaacauaggggaccaaagggcccucuaucauacagaaaaugcuuaugucucuguagugucuucacauuauagcagaagauucaccccagaaauagccaaaagacccaaggugagaaaucaggaaggaagaaucaacuacuacuggacccugcuagaacccggggauacaauaauauuugaggcaaauggaaaucuaauagcaccaagguaugccuucgaacugaguaaggguuuuggaucaggaaucaucacaucaaaugcaccaaugggugaauguaaugcaaagugucaaacaccucagggagcuauaaacagcagucuuccuuuccagaauguacacccaguaacaauaggagaguguccaaaguaugucaaaagugcaaaauuaaggaugguuacaggacuaaggaacaccccauccauucaauccagagguuuguuuggagccauugccgguuucauugaaggaggguggacuggaaugguacaugguugguaugguuaucaccaucagaaugagcaaggaucuggguaugcugcagaacaacaaagcacacaauaugccauuaaugggauuacaaacaaggugaauucuguaauugagaaaaugaacacucaauucacagcugugggcaaagaauucaacaaacuggaaagaagaauggaaaacuuaaauaaaaggguugaugauggguuucuagacauuuggacauauaaugcagaauuguuaguucuacuggaaaaugaaaggacuuuggauuuccaugacuccaacgugaagaaucuguaugagaaaguaaaaagccaauuaaaaaauaaugccaaagaaauaggaaacggguguuuugaauucuaucauaaguguaacgaugaaugcauggagagugugaaaaauggaacuuaugacuauccaaaauauuccgaagaaucaaaguuaaacagggagaaaauugauggagugaaauuggaaucaaugggagucuauaauauccuggcgaucuacucaacagucgccaguucccuaguucuuuuagucucccugggggcaaucagcuucuggauguguuccaaugggucuuuacaguguagaauaugcaucuaa

SEQ ID NO: 36858 - RNA, 1698 nt, Artificial Sequence
  hemagglutinin__InfluenzaA__ADV69095
augaaaguaaaacuaaugguucuguuauguacauuuacagcuacauaugcagacacaauauguguaggcuaccaugccaacaacucaacugacacuguugacacaguacuugagaagaaugugacagugacacacucugucaaccuacuugaggacagccacaauggaaaacuaugucuacuaaaaggaauagcuccacuacaauuggguaguugcagcguugccggauggaucuuaggaaacccagaaugcgaauugcugauuuccaaggaaucaugguccuacauuguagaaccaccaaauccugagaauggaacauguuacccaggguauuucacagacuaugaagaacugagggagcaauugaguucaguaucuucauuuaagagguucgaaauauuccccaaagagagcucauggcccaaccacaccguaaacggagugucaucaucaugcucccauaacggggaaagcagcuucuacagaaauuugcuauggcugacggugaaggacgguuuguacccaaaccugagcaaguccuauacaaacaaaaaggagaaagaaguccuuguacuaugggguguucaucacccaucuaacauaggggaccaaagggcccucuaucauacagaaaaugcuuaugucucuguagugucuucacauuauagcagaagauucaccccagaaauagccaaaagacccaaggugagaaaucaggaaggaagaaucaacuacuacuggacucugcuagaacccggggauacaauaauauuugaggcaaauggaaaucuaauagcaccaagguaugccuucgaacugaguaaggguuuuggaucaggaaucaucacaucaaaugcaccaaugggugaauguaaugcaaagugucaaacaccucagggagcuauaaacagcagucuuccuuuccagaauguacacccaguaacaauaggagaguguccaaaguaugucaggaguacaaaauuaaggaugguuacaggacuaaggaacaccccauccauucaauccagagguuuguuuggagccauugccgguuucauugaaggaggguggacuggaaugguagaugguugguaugguuaucaucaucagaaugagcaaggaucuggguaugcugcagaucaacaaagcacacaaaaugccauuaaugggauuacaaacaaggugaauucuguaauugaaaaaaugaacacucaauucacagcugugggcaaagaauucaacaaauuggaaagaagaauggaaaacuuaaauaaaaagauugaugauggguuucuagacauuuggacauauaaugcagaauuguuaguucuacuggaaaaugaaaggacuuuggauuuccaugacuccaacgugaagaaucuguaugagaaaguaaaaagccaauuaaaaaauaaugccaaagaaauaggaaacggguguuuugaauucuaucauaaguguaacgaugaaugcauggagagugugaaaaauggaacuuaugacuauccaaaauauuccgaagaaucaaaguuaaacagggagaaaauugauggagugaaauuggaaucaaugggagucuauaauauccuggcgaucuacucaacagucgccaguucccuaguucuuuuagucucccugggggcaaucagcuucuggauguguuccaaugggucuuuacaguguagaauaugcaucuaa

SEQ ID NO: 36859 - RNA, 1698 nt, Artificial Sequence
  hemagglutinin__InfluenzaA__ADV69096
augaaaguaaaacuaaugguucuguuauguacauuuacagcuacauaugcagacacaauauguguaggcuaccaugccaacaacucaacugacacuguugacacaguacuugagaagaaugugacagugacacacucugucaaccuacuugaggacagccacaauggaaaacuaugucuacuaaaaggaauagcuccacuacaauuggguaguugcagcguugccggauggaucuuaggaaacccagagugcgaauugcugauuuccaaggaaucuugguccuacauuguagaaacaccaaauccugagaauggaacauguuacccaggguaugucacagacuaugaagaacugagggagcaauugaguucaguaucuucauuuaagagguucgaaauauuccccaaagagagcucauggcccaaccacaccguaaccggagugucaucaucaugcucccauaacgggaaaagcagcuucuacagaaauuugcuauggcugacggugaagaacggucuguacccaaaccugagcaaguccuauacaaacaaaaaggagaaagaaguccuuguacuaugggguguucaucacccaucuaacauaggggaccaaagggcccucuaucauacagaaaaugcuuaugucucuguagugucuucacauuauagcagaagauucaccccagaaauagccaaaagacccaaggugagaaaucaggaaggaagaaucaacuacuacuggacccugcuagaacccggggauacaauaauauuugaggcaaauggaaaucuaauagcaccaagguaugccuucgaacugaguaaggguuuuggaucaggaaucaucacaucaaaugcaccaaugggugaauguaaugcaaagugucaaacaccuaagggagcuauaaacagcagucuuccuuuccagaauguacacccaguaacaauaggagaguguccaaaguaugucaaaagugcaaaauuaaggaugguuacaggacuaaggaacaccccauccauucaauccagagguuuguuuggagccauugccgguuucauugaaggaggguggacuggaaugguagaugguugguaugguuaucaccaucagaaugagcaaggaucuggguaugcugcagaccaacaaagcacacaaaaugccauuaaugggauuacaaacaaggugaauucugugauugaaaaaaugaacacucaauucacagcugugggcaaagaauucaacaaacuggaaagaagaauggaaaacuuaaauaaaaagguugaugauggguuucuagacauuuggacauauaaugcagaauuguuaguucuacuggaaaaugaaaggacuuuggauuuccaugaauccaacgugaagaaucuguaugagaaaguaaaaagccaauuaaaaaauaaugccaaagaaauaggaaacggguguuuugaauucuaucauaaguguaacgaugaaugcauggagagugugaaaaauggaacuuaugacuauccaaaauauuccgaagaaucaaaguuaaacagggagaaaauugauggagugaaauuggaaucaaugggagucuauaauauccuggcgaucuacucaacagucgccaguucccuaguucuuuuagucucccugggggcaaucagcuucuggauguguuccaaugggucuuuacaguguagaauaugcaucuaa

SEQ ID NO: 36860 - RNA, 1698 nt, Artificial Sequence
  hemagglutinin__InfluenzaA__ADV69097
augaaaguaaaacuacugauccuguuauguacauuuacagcuacauaugcggacacaauauguauaggcuaccaugccaacaacucaaccgacacagucgacacaguacuugagaagaaugugacaguuacacacucugucaaucuacuugaggacagucacaauggaaagcugugccuacuaaagggaauagccccccuacaauuggguaauugcagcguugccggauggaucuuaggaaacccagaaugcgaauuacugauuuccaagaaaucaugguccuacauuguagaaacaccaaauccugggaauggagcauguuacccaggguauuucgccgacuaugaggagcuaagggagcaauugaguucaguaucuucauuugagagauucgaaauauuccccaaagaaagcucaugguccaaccacaacguaaacggaguaucagcaucaugcucccauaaugggaaaagcaguuuuuacagaaaucugcuauggcugacggggaaaaaugguuuguacccaacccugaccaaguccuaugcaaacgacaaagagaaagaaguccuuauacuaugggguguucaucacccgucuaacauaggggaccaaaggacccucuaucacacagaaaaugcuuaugucucuguaaugucuucacauuauagcagaagauucaccccagaaauauccaaaaggcccaaaguaagagaucaggaaggaagaaucaacuacuacuggacucugcuagaaccaggggauacaauaauauuugaggcaaaugggaaucuaauagcgccaugguaugcuuucgcacugaguagaggcuuuggaucaggaaucaucaccucaaaugcaccaauggaugaaugcgaugcgaagugucaaacaccucagggagcuauaaacagcagucuuccuuuccagaauauacacccagucacaauaggagaguguccaaaguaugucaggagugcaaaauuaaggaugguuacaggacuaaggaacaccccauccauucaauccagagguuuguuuggagccauugccgguuucauugaaggaggguggacuggaaugguagaugguugguaugguuaucaucaucagaaugagcaaggaucuggauaugcugcagaucaagaaagcacacaaaaugccauuaacgagauuacaaacaaagagaauucuguaauugagaaaaugaacacucaauucacaucugugggcaaagaauucaacaaauuggaaagaaggauggaaaacuuaaauaaaaaaguugaugauggguuucuagacauuuggacauauaaugcagaguuguugguucuacuggaaaaugaaagaacuuuggauuuccacgacuccaaugugaagagucuguacgagaaaguaaaaauccaauuaaagaauaaugccaaagaaauaggaaaugggugcuuugaauucuaucacaaguguaacaaugaaugcauggagagugugagaaauggaacuuaugacuauccaaaauauuccgaagaaucaaaguuaaacagggaaaaaauugauggagugaaauuggacucaaugggagucuaucagauucuggcgaucuacucaacugucgccaguucccugguucuuuuggucucccugggggcaaucagcuucuggauguguuccaaugggucuuugcaauguagaauaugcaucuaa

SEQ ID NO: 36861 - RNA, 1698 nt, Artificial Sequence
  hemagglutinin__InfluenzaA__ADV69098
augaaaguaaaacuaauuguucuguuauguacauuuacagcuacauaugcagacacaauauguguaggcuaccaugccaacaacucaacugacacuguugacacaguacuugagaagaaugugacagugacacacucugucaaccuacuugaggacagccacaauggaaaacuaugucuacuaaaaggaauagcuccacuacaauuggguaguugcagcguugccggauggaucuuagggaacccagagugcgaacugcugauuuccaaggaaucaugguccuacauuguagaaacaccaaauccugagaauggaacauguuacccaggguauuucacagacuaugaagaacugagggagcaauugaguucaguaucuucauuuaagagguucgaaauauuccccaaagagagcucauggcccaaccacaccguaaccggagugucaucaucaugcucccauaacgggaacagcagcuucuacagaaauuugcuauggcugacggugaagaacgguuuguacccaaaccugagcaaguccuauacaaacaaaaaggagaaagaaguccuuguacuaugggguguucaucacccaucuaacauagaggaccaaagggcccucuaucauacagaaaaugcuuaugucucuguagugucuucacauuauagcagaagauucaacccagaaauagccaagagacccaaggugagaaaucaggaaggaagaaucaacuacuacuggacucugcuagaacccggggauacaauaauauuugaggcaaauggaaaucuaauagcaccaagguaugccuucgaacugaguaaggguuuuggaucaggaaucaucacaucaaaugcaccaaugggugaauguaaugcaaagugucaaacaccucagggagcuauaaacagcaaucuuccuuuccagaauguacacccaguaacaauaggagaguguccaaaguaugucaggagugcaaaauuaaggaugguuacaggacuaaggaacaccccauccauccaauccagagguuuguuuggagccauugccgguuucauugaaggaggauggacuggaaugguagaugguugguaugguuaucaucaucacaaugagcaaggaucuggauaugcugcaaaccaaaaaagcacaccaaaugccauuaacgguauuacaaacaaagugaauucuguaauugaaaaaaugaacacucaauucacagcugugggcaaagaauucaacaaauuggaaagaagaauggaaaaccuaaauaaaaagguugaugauggguuucuagacauuuggacauauaaugcagaauuguuaguucuacuggaaaaugaaaggacuuuggauuuccaugacuccaacgugaagaaucuguaugagaaaguaagaagccaauuaaaaaauaaugccaaagaaauaggaaacggguguuuugaauucuaucauaaguguaacgaugaaugcauggagagugugaaaaauggaacuuaugacuauccaaaauauuccgaagaaucaaaguuaaacagggagaaaauugauggagugaaauuggaaucaaugggagucuauaauauccuggcgaucuacucaacagucgccaguucccuaguucuuuuagucucccugggggcaaucagcuucuggauguguuccaaugggucuuuacaguguagaauaugcaucuaa

SEQ ID NO: 36862 - RNA, 1698 nt, Artificial Sequence
  hemagglutinin__InfluenzaA__ADV69099
augaaaguaaaacuaauuguucuguuauguacauuuacagcuacauaugcagacacaauauguguaggcuaccaugccaacaacucaacugacacuguugacacaguacuugagaagaaugugacagugacacacucugucaaccuacuugaggacagccacaauggaaaacuaugucuacuaaaaggaauagcuccacuacaauuggguaguugcagcguugccggauggaucuuagggaacccagagugcgaacugcugauuuccaaggaaucaugguccuacauuguagaaacaccaaauccugagaauggaacauguuacccaggguauuucacagacuaugaagaacugagggagcaauugaguucaguaucuucauuuaagagguucgaaauauuccccaaagagagcucauggcccaaccacaccguaaccggagugucaucaucaugcucccauaacgggaacagcagcuucuacagaaauuugcuauggcugacggugaagaacgguuuguacccaaaccugagcaaguccuauacaaacaaaaaggagaaagaaguccuuguacuaugggguguucaucacccaucuaacauagaggaccaaagggcccucuaucauacagaaaaugcuuaugucucuguagugucuucacauuauagcagaagauucaacccagaaauagccaagagacccaaggugagaaaucaggaaggaagaaucaacuacuacuggacucugcuagaacccggggauacaauaauauuugaggcaaauggaaaucuaauagcaccaagguaugccuucgaacugaguaaggguuuuggaucaggaaucaucacaucaaaugcaccaaugggugaauguaaugcaaagugucaaacaccucagggagcuauaaacagcaaucuuccuuuccagaauguacacccaguaacaauaggagaguguccaaaguaugucaggagugcaaaauuaaggaugguuacaggacuaaggaacaccccauccauccaauccagagguuuguuuggagccauugccgguuucauugaaggaggauggacuggaaugguaaaugguugguaugguuaucaucaucacaaugagcaaggaucuggauaugcugcaaaccaacaaagcccaccaaaugccauuaacgguauuacaaacaaagugaauucuguaauugaaaaaaugaacacucaauucacagcugugggcaaagaauucaacaaauuggaaagaagaauggaaaaccuaaauaaaaagguugaugauggguuucuagacauuuggacauauaaugcagaauuguuaguucuacuggaaaaugaaaggacuuuggauuuccaugacuccaacgugaagaaucuguaugagaaaguaagaagccaauuaaaaaauaaugccaaagaaauaggaaacggguguuuugaauucuaucauaaguguaacgaugaaugcauggagagugugaaaaauggaacuuaugacuauccaaaauauuccgaagaaucaaaguuaaacagggagaaaauugauggagugaaauuggaaucaaugggagucuauaauauccuggcgaucuacucaacagucgccaguucccuaguucuuuuagucucccugggggcaaucagcuucuggauguguuccaaugggucuuuacaguguagaauaugcaucuaa

SEQ ID NO: 36863 - RNA, 1698 nt, Artificial Sequence
  hemagglutinin__InfluenzaA__ADV69100
augaaaguaaaacuacugauccuguuauguacauuuacagcuacguaugcggacacaauauguauaggauaccaugccaacaacucaaccgacacuguugacacagugcuugaaaagaaugugacagugacacacucugucaaccuacuugaggacagucacaaugggaaacugugccuacuaaagggaauagccccccuacaauuggguaauugcagcguugccggauggauauuaggaaacccagaaugcgaaucacugauuuccaagaaaucaugguccuacauuguagaaacaccaaagccugagaauggaacauguuacccaggggaguucgcugacuaugaggagcuaagagagcaauugaguucaguaucuucauuugagagauucgaaauauuccccaaagaaagcucauggcccaaccacacugcagccggagugucagcaucaugcucccauaauggggaaagaaguuuuuacaaaaaucugauauggcugacagugaaaaaugguuuguacccaaacuugagcaaguccuauaaaaacgacaaagagaaagaaguccuuauacuaugggguguucaucauccgccuaacauagagaaccaaaggacccucuaucacacagaaaauacuuaugucucuguagugucuucacauuauagcggaagauucaccccagaaauaaccaaaaggcccaaaguaagagaucaggaaggaagaaucaacuacuacuggacucugcuggaacccggggauacaauaauauuugaggcaaaugguaaucuaauagcgccaugguaugcuuucacacugaguagaggccuuggaucaggaaucgucaccucuaaugcaccaauggacaaaugugaugcgaagugucaaacaccucauggagcuauaaacagcagucuuccuuuccagaauguacacccagucacaauaggagaauguccaaaguaugucaggagugcaaaauuaaggaugguuacaggacuaaggaacaucccauccauucaauccagagguuuguuuggggccauugccgguuucauugaagggggguggacuggaaugguagaugggugguaugguuaucaucaucagaaugagcagggaucuggcuaugcugcagaucaagaaagcacacaaaaugccauuaacgggauuacaaacaaagugaauucuguaauugaaaaaaugaacacucaauucacagcugugggcaaggaauucaacaaauuggaaagaaggauggaaaacuuaaauaaaaagguugaugauggguuucuagacauuuggacauacaaugcagaguuguugguucuacuggaaaaugaaagaacuuuggacuuccacgauuccaaugugaagagucuguacgagaaaguaaaaagccaauuaaagaauaaugcuaaagaaauagggaaugggugcuuugaauucuaucacaaguguaacaacgaaugcauggagagugugaaaaauggaacuuaugacuauccaaaauauuccgaagaaucaaaguuaaacagggaaaaaauugauggaguuaaauuggacucaaugggggucuaucggauuuuggcgaucuacucgacugucgccaguucccuaguucuuuuggucucccugggggcaaucagcuucuggauguguuccaaugggucuuugcaauguagaauaugcaucuag

SEQ ID NO: 36864 - RNA, 1698 nt, Artificial Sequence
  hemagglutinin__InfluenzaA__ADV69101
augaaaguaaaacuacugauccuguuuuguacauuuacagcuacauaugcggacacaauauguauaggauaccaugccaacaacucaaccgacacuguugacacaguacuugaaaagaaugugacagugacacacucugucaaccuacuugaggacagucacaaugggaagcugugccuacuaaagggaauagccccccuacaauuggguaauugcagcguugccggauggauauuaggaaacccagaaugcgaaucacugauuuccaagaaaucaugguccuacauuguagaaacaccaaauccugagaauggagcauguuacccaggggaguucgccgacuaugaggagcuaagggagcaauugaguucaguaucuucauuugagagauucgaaauauuccccaaagaaagcucauggcccaaccacacugcaaccggagugucagccucaugcucccauaauggggaaagaaguuuuuacagaaaucugauauggcugacagugaaaaaugguuuguacccaaaccugagcaaguccuaugaaaacgacaaagagaaagaaguccuuauacuaugggguguucaucauccgccuaacauagagaaccaaaggacccucuaucacacagaaaaugcuuaugucucuguagugucuucacauuauagcggaagauucaccccagaaauaaccaaaaggcccaaaguaagagaucaggaaggaagaaucaacuacuacuggacucugcuggaacccggggauacaauaauauuugaggcaaauggaaaucuaauagcgccaugguaugcuuucacacugaguagaggccuuggaucaggaaucaucaccucuaaugcaccaauggacgaaugugauucgaagugucaaacaccucaaggagcuauaaacagcagucuuccuuuccagaauguacacccagucacaauaggagaauguccaaaguaugucaggagugcaaaauuaaggaugguuacaggacuaaggaacaucccauccauucaauccagagguuuguuuggggccauugccgguuucauugaagggggguggacuggaaugguagaugggugguaugguuaucaucaucagaaugagcagggaucuggcuaugcugcagaucaagaaagcacacaaaaugccauuaacgggauuacaaacaaggugaauucuguaauugagaaaaugaacccucaauucacagcugugggcaaggaauucaacaaauuggaaagaaggauggaaaacuuaaacaaaaagguugaugauggguuucuagacauuuggacauacaaugcagaguuguugguucuacuggaaaaugaaagaacuuuggacuuccacgacuccaaugugaagagucuguacgagaaaguaaaaagccaauuaaagaauaaugcuaaagaaauagggaaugggugcuuugaauucuaucacaaguguaacaacgaaugcauggagagugugaaaaauggaacuuaugacuauccaaaauauuccgaagaaucaaaguuaaacagggaaaaaauugauggaguuaaauuggacucaaugggggucuaucggauucuggcgaucuacucaacugucgccaguucccugguucuuuuggucucccugggggcaaucagcuucuggauguguuccaaugggucuuugcaauguagaauaugcaucuag

SEQ ID NO: 36865 - RNA, 1698 nt, Artificial Sequence
  hemagglutinin__InfluenzaA__ADV69102
augaaaguaaaacuacugauccuguuuuguacauuuacagcuacauaugcggacacaauauguauaggauaccaugccaacaacucaaccgacacuguugacacaguacuugaaaagaaugugacagugacacacucugucaaccuacuugaggacagucacaaugggaagcugugccuacuaaagggaauagccccccuacaauuggguaauugcagcguugccggauggauauuaggaaacccagaaugcgaaucacugauuuccaagaaaucaugguccuacauuguagaaacaccaaauccugagaauggagcauguuacccaggggaguucgccgacuaugaggagcuaagggagcaauugaguucaguaucuucauuugagagauucgaaauauuccccaaagaaagcucauggcccaaccacacugcaaccggagugucagccucaugcucccauaauggggaaagaaguuuuuacagaaaucugauauggcugacagugaaaaaugguuuguacccaaaccugagcaaguccuaugaaaacgacaaagagaaagaaguccuuauacuaugggguguucaucauccgccuaacauagagaaccaaaggacccucuaucacacagaaaaugcuuaugucucuguagugucuucacauuauagcggaagauucaccccagaaauaaccaaaaggcccaaaguaagagaucaggaaggaagaaucaacuacuacuggacucugcuggaacccggggauacaauaauauuugaggcaaauggaaaucuaauagcgccaugguaugcuuucacacugaguacaggccuuggaucaggaaucaucaccucuaaugcaccaauggacgaaugugauucgaagugucaaacaccucaaggagcuauaaacagcagucuuccuuuccagaauguacacccagucacaauaggagaauguccaaaguaugucaggagugcaaaauuaaggaugguuacaggacuaaggaacaucccauccauucaauccagagguuuguuuggggccauugccgguuucauugaagggggguggacuggaaugguagaugggugguaugguuaucaucaucagaaugagcagggaucuggauaugcugcagaucaagaaagcacacaaaaugccauuaacgggauuacaaacaaggugaauucuguaauugagaaaaugaacacucaauucacagcugugggcaaggaauucaacaaauuggaaagaaggauggaaaacuuaaacaaaaagguugaugauggguuucuagacauuuggacauacaaugcagaguuguugguucuacuggaaaaugaaagaacuuuggacuuccacgacuccaaugugaagagucuguacgagaaaguaaaaagccaauuaaagaauaaugcuaaagaaauagggaaugggugcuuugaauucuaucacaaguguaacaacgaaugcauggagagugugaaaaauggaacuuaugacuauccaaaauauuccgaagaaucaaaguuaaacagggaaaaaauugauggaguuaaauuggacucaaugggggucuaucggauucuggcgaucuacucaacugucgccaguucccugguucuuuuggucucccugggggcaaucagcuucuggauguguuccaaugggucuuugcaauguagaauaugcaucuag

SEQ ID NO: 36866 - RNA, 1698 nt, Artificial Sequence
  hemagglutinin__InfluenzaA__ADV69103
augaaaguaaaacuaaugguucuguuauguacauuuacagcuacauaugcagacacaauauguguaggcuaccaugccaacaacucaacugacacuguugacacaguacuugagaagaaugugacagugacacacucugucaaccuacuugaggacagccacaauggaaaacuaugucuacuaaaaggaauagcuccacuacaauuggguaguugcagcguugccggauggaucuuaggaaacccagagugcgaauugcugauuuccaaggaaucaugguccuacauuguagaaacaccaaauccugagaauggaacauguuacccaggguauuucacagacuaugaagaacugagggagcaauugaguucaguaucuucauuuaagagguucgaaauauuccccaaagagagcucauggcccaaccacaacguaaccggagugucaucaucaugcucccauaacgggaaaagcagcuucuacagaaauuugcuauggcugacggugaagaacggucuguacccaaaccugagcaaguccuauacaaacaaaaaggagaaagaaguccuuguacuaugggguguucaucacccaucuaacauaggggaccaaagggcccucuaucauacagaaaaugcuuaugucucuguagugucuucacauuauagcagaagauucaccccagaaauagccaaaagacccaaggugagaaaucaggaaggaagaaucaacuacuacuggacccugcuagaacccggggauacaauaauauuugaggcaaauggaaaucuaauagcaccaagguaugccuucgaauugaguaaggguuuuggaucaggaaucaucacaucaaaugcaccaauaggugaauguaaugcaaagugucaaacaccucagggagcuauaaacagcagucuuccuuuccagaauguaaacccaguaacaauaggagaguguccaaaguaugucaaaagugcaaaauuaaggaugguuacaggacuaaggaacaccccauccauucaauccagagguuuguuuggagccauugccgguuucauugaaggaggguggacuggaaugguagaugguugguaugguuaucaccaucagaaugagcaaggaucuggguaugcugcagaccaacaaagcacacaaaaugccauuaaugggauuacaaacaaggugaacucugugauugaaaaaaugaacacucaauucacagcugugggcaaagaauucaacaaacuggaaagaagaauggaaaacuuaaauaaaaagguugaugauggguuucuagacauuuggacauauaaugcagaauuguuaguucuacuggaaaaugaaaggacuuuggauuuccaugacuccaacgugaagaaucuguaugagaaaguaaaaagccaauuaaaaaauaaugccaaagaaauaggaaacggguguuuugaauucuaucauaaguguaacgaugaaugcauggagagugugaaaaauggaacuuaugacuauccaaaauauuccgaagaaucaaaguuaaacagggagaaaauugauggagugaaauuggaaucaaugggagucuauaauauccuggcgaucuacucaacaguagccaguucccuaguucuuuuagucucccugggggcaaucagcuucuggauguguuccaaugggucuuuacaguguagaauaugcaucuaa

SEQ ID NO: 36867 - RNA, 1698 nt, Artificial Sequence
  hemagglutinin__InfluenzaA__ADV69104
augaaaguaaaacuacugauccuguuuuguacauuuacagcuacauaugcggacacaauauguauaggauaccaugccaacaacucaaccgacacuguugacacaguacuugaaaagaaugugacagugacacacucugucaaccuacuugaggacagucacaaugggaagcugugccuacuaaagggaauagccccccuacaauuggguaauugcagcguugccggauggauauuaggaaacccagaaugcgaaucacugauuuccaagaaaucaugguccuacauuguagaaacaccaaauccugagaauggagcauguuacccaggggaguucgccgacuaugaggagcuaagggagcaauugaguucaguaucuucauuugagagauucgagauauuccccaaagaaagcucauggcccaaccacacugcaaccggagugucagccucaugcucccauaauggggaaagaaguuuuuacagaaaucugauauggcugacagugaaaaaugguuuguacccaaaccugagcaaguccuaugaaaacgacaaagagaaagaaguccuuauacuaugggguguucaucauccgccuaacauagagaaccaaaggacccucuaucacacagaaaaugcuuaugucucuguagugucuucacauuauagcggaagauucaccccagaaauaaccaaaaggcccaaaguaagagaucaggaaggaagaaucaacuacuacuggacucugcuggaacccggggauacaauaauauuugaggcaaauggaaaucuaauagcgccaugguaugcuuucacacugaguagaggccuuggaucaggaaucauuaccucuaaugcaccaauggacgaaugugauucgaagugucaaacaccucaaggagcuauaaacagcagucuuccuuuccagaauguacacccagucacaauaggagaauguccaaaguaugucaggagugcaaaauuaaggaugguuacaggacuaaggaacaucccauccauucaauccagagguuuguuuggggccauugccgguuucauugaagggggguggacuggaaugguagaugggugguaugguuaucaucaucagaaugagcaaggaucuggauaugcugcagaucaagaaagcacacaaaaugccauuaacgggauuacaaacaaggugaauucuguaauugagaaaaugaacacucaauucacagcugugggcaaggaauucaacaaauuggaaagaaggauggaaaacuuaaacaaaaagguugaugauggguuucuagacauuuggacauacaaugcagaguuguugguucuacuggaaaaugaaagaacuuuggacuuccacgacuccaaugugaagagucuguacgagaaaguaaaaagccaauuaaagaauaaugcuaaagaaauagggaaugggugcuuugaauucuaucacaaguguaacaacgaaugcauggagagugugaaaaauggaacuuaugacuauccaaaauauuccgaagaaucaaaguuaaacagggaaaaaauugauggaguuaaauuggacucaaugggggucuaucggauucuggcgaucuacucaacugucgccaguucccugguucuuuuggucucccugggggcaaucagcuucuggauguguuccaaugggucuuugcaauguagaauaugcaucuag

SEQ ID NO: 36868 - RNA, 1698 nt, Artificial Sequence
  hemagglutinin__InfluenzaA__ADV69105
augaaaguaaaacuacugauccuguuauguacauuuacagcuacauaugcggacacaauauguauaggauaccaugccaacaacucaaccgacacuguugacacaguacuugaaaagaaugugacagugacacacucugucaaccuacuugaggacagucacaaugggaagcugugccuacuaaagggaauagccccccuacaauuggguaauugcagcguugccggauggauauuaggaaacccagaaugcgaaucacugauuuccaagaaaucaugguccuacauuguagaaacaccaaauccugagaauggagcauguuacccaggggaguucgccgacuaugaggagcuaagggagcaauugaguucaguaucuucauuugagagauucgaaauauuccccaaagaaagcucauggcccaaccacacugcagccggagugucagcaucaugcucccauaauggggaaagaaguuuuuacagaaaucugauauggcugacagugaaaaaugguuuguacccaaaccugagcaaguccuauaaaaacgacaaagagaaagaaguccuuauaauaugggguguucaucauccgccuaacauagagaaccaaaggacccucuaucacacagaaaaugcuuaugucucuguagugucuucacauuauagcggaagauucaccccagaaauaaccaaaaggcccaaaguaagagaucaggaaggaagaaucaacuacuacuggacucugcuggaacccggggauacaauaauauuugaggcaaauggaaaucuaauagcgccaugguaugcuuucacacugaguagaggccuuggaucaggaaucaucaccucuaaugcaccaauggacgaaugugaugcgaagugucaaacaccucagggagcuauaaacagcagucuuccuuuccagaauguacacccagucacaauaggagaauguccaaaguaugucaggagugcaaaauuaaggaugguuacaggacuaaggaacaucccauccauucaauccagagguuuguuuggggccauugccgguuucauugaagggggauggacuggaaugguagaugggugguaugguuaucaucaucagaaugagcagggaucuggcuaugcugcagaucaagaaagcacacaaaaugccauuaacgggauuacaaacaaggugaauucuguaauugaaaaaaugaacacccaauucacagcugugggcaaggaauucaacaaauuggaaagaaggauggaaaacuuaaauaaaaagguugaugauggguuucuagacauuuggacauacaaugcagaguuguugguucuacuggaaaaugaaagaacuuuggacuuccacgacuccaaugugaagagucuguacgagaaaguaaaaagccaauuaaagaauaaugcuaaagaaauagggaaugggugcuuugaauucuaucacaaguguaacaacgaaugcauggagagugugaaaaauggaacuuaugacuauccaaaauauuccgaagaaucaaaguuaaacagggaaaaaauugauggaguuaaauuggacucaaugggggucuaucggauucuggcgaucuacucaacugucgccaguucccuaguucuuuuggucucccugggggcaaucagcuucuggauguguuccaaugggucuuugcaauguagaauaugcaucuag

SEQ ID NO: 36869 - RNA, 1698 nt, Artificial Sequence
  hemagglutinin__InfluenzaA__ADV69106
augaaaguaaaacuacugauccuguuauguacauuuacagcuacauaugcggacacaauauguauaggcuaccaugccaacaacucaaccgacacaguugacacaguacuugagaaaaaugugacaguuacacacucugucaaccuacuugaggacagucacaauggaaagcugugccuacuaaagggaauagccccccuacaauuggguaauugcagcguugccggauggauauuaggaaacccagaaugcgaaucacugauuuccaagaagucaugguccuacauuguagaaacaccaaauccugggaauggagcauguuacccaggguauuucgccgacuaugaggagcuaagggagcaauugaguucaguaucuucauuugagagauucgaaauguuccccaaagaaagcucauggcccaaccacaacguaaacggaguaucagcaucaugcucccauaacgggaaaagcaguuuuuacaggaaucugcuauggcugacgaggaaaaaugguuuguauccaaaccugaccaaguccuaugcaaacaacaaugauaaagaaguccuuauacuaugggguguucaucacccgucuaacauaggggaccaaaggacccucuaucacacagaaaaugcuuaugucucuguaaugucuucacauuauagcagaagauucaccccagaaauaaccaaaaggcccaaaguaagagaucaggaaggaagaaucaacuacuacuggacucugcuagaacccggggauacaauaauauuugaggcaaaugggaaucuaauagcgccaugguaugcuuucgcacugaguagaagcuuuggaucaggaaucaucaccucaagugcaccaauggaugaaugugaugcgaagugucaaacaccucagggagcuauaaacagcagucuuccuuuccagaauguacacccagucacaauaggagaauguccaaaguaugucaggagugcaaaauuaaagaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaagaaagcacacaaaaugccauuaacgggauuacaaacaaggugaauucuguaauugagaaaaugaacacucaauucacagcugugggcaaagaauucaacaaauuggaaaaaaggauggaaaacuuaaauaaaaaaguugaugauggguuucuagacauuuggacauauaaugcagaguuguugguucuacuggaaaaugaaagaacuuuggauuuccacgacuccaaugugaaaagucuguacgagaaaguaaaaauccaauuaaagaauaaugccaaagaaauaggaaaugggugcuuugaauucuaucacaaguguaacaaugaaugcauggagagugugagaaauggaacuuaugacuauccaaaauauuccgaagaaucaaaguuaaacagggaaaaaauugauggagugaaauuggacucaaugggggucuaucagauucuggcgaucuacucaacugucgccaguucccugguucuuuuggucucccugggggcaaucagcuucuggauguguuccaaugggucuuugcaauguagaauaugcaucuaa

SEQ ID NO: 36870 - RNA, 1698 nt, Artificial Sequence
  hemagglutinin__InfluenzaA__ADV69107
augaaaguaaaacuacugauccuguuauguacauuuacagcuacauaugcggacacaauauguauaggauaccaugccaacaacucaaccgacacuguugacacaguacuugaaaagaaugugacagugacacacucugucaaccuacuugaggacagucacaauggaaagcugugccuacuaaagggaauagccccccuacaauuggguaauugcagcguugccggauggauauuaggaaacccagaaugcgaaucacugauuuccaaggaaucaugguccuacauuguagaaacaccuaauucugauaauggagcauguuacccagggcaguucaccgacuaugaggagcuaagggagcaauugaguucaguaucuucauuugagagauucgagauauuccccaaagaaagcucauggcccaaccacacuguaaccggagugucagcaucaugcucccauaauggggaaagaaguuuuuacagaaaucugauauggcugacagugaaaaaugguuuguacccaaaccugagcaaguccuaugaaaacgacaaagagaaagaaguccuuauauuaugggguguucaucauccgcccaacauaggggaccaaaggacacucuaucacacagaaaaugcuuauaucucuguagugucuucacauuauagcggaagauucaccccagaaauaaccaaaaggcccaaaguaagagaucaggaaggaagaaucaacuacuacuggacucugcuggaacccggggauacaauaauauuugaggcaaauggaaaucuaauagcgccaugguaugcuuucgcacugaguagaggccuuggaucaggaaucaucaccucuaaugcaccaauggacaaaugugaugcaaagugucaaacaccucagggagcuauaaacagcagucuuccuuuccagaauguacacccagucacaauaggagaauguccaaaauaugucaggaguacaaaauuaaggaugguuacaggacuaaggaacaucccauccauucaauccagagguuuguuuggggccauugccgguuucauugaagggggauggacuggaaugguagaugggugguaugguuaucaucaucagaaugagcaaggaucuggcuaugcugcagaucaagaaagcacacaaaaugccauuaacgggauuacaaacaaggugaauucuguaauugagaaaaugaacacucaauucacagcugugggcaaggaauucaacaaauuggaaagaaggauggaaaacuuaaauaaaaagguugaugauggguuucuagacauuuggacauacaaugcagaguuguugguucuacuggaaaaugaaagaacuuuggacuuccacgacuccaaugugaagagucuguacgagaaaguaaaaagccaauuaaagaauaaugcuaaagaaauaggaaaugggugcuuugaauucuaucacaaguguaacaacgaaugcauggagagugugagaaauggaacuuaugacuauccaaaauauuccgaagaaucaaaguuaaacagggaaaaaauugauggagugaaauuggacucaaugggggucuaucggauucuggcgaucuacucaacugccgccaguucccugguucuuuuggucucccugggggcaaucagcuuuuggauguguuccaaugggucuuugcaauguagaauaugcaucuaa

SEQ ID NO: 36871 - RNA, 1698 nt, Artificial Sequence
  hemagglutinin__InfluenzaA__ADV69108
augaaaguaaaacuacugguucuguuauguacauuuacagcuacauaugcagacacaauauguguaggcuaccaugccaacaacucaacugacacuguugacacaguacuugagaagaaugugacaguaacacacucugucaaccuacucgaggacagccacaauggaaaacuaugucuacuaaaaggaauagcuccacuacaauuggguaguugcagcguugccggauggaucuuaggaaacccagagugcgaauugcugauuuccaaggaaucaugguccuacauuguagaaacaccaaauccugagaauggaacauguuacccaggguauuucacagacuaugaagaacugagggagcaauugaguucaguaucuucauuuaagagguucgaaauauuccccaaagagagcucauggcccaaccacaccguaaccggagugucaucaucaugcucccauaacgggaaaagcagcuucuacagaaauuugcuauggcugacgaugaagaacgguuuguacccaaaccugagcaaguccuauacaaacaaaaaggagaaagaaguccuuguacuaugggguguucaucacccaucuaacauaggggaccaaagggcccucuaucauacagaaaaugcuuaugucucuguagugucuucacauuauagcagaagauucaccccagaaauagccaaaagacccaaggugagaaaucaggaaggaagaaucaacuacuacuggacucugcuagaacccgaggauacaauaauauuugaggcaaauggaaaucuaauagcaccaagguaugccuucgaacugaguaaggguuuuggaucaggaaucaucacaucaaaugcaccaaugggugaauguaaugcaaagugucaaacaccucagggagcuauaaacagcagucuuccuuuccagaauguacacccaguaacaauaggagaguguccaaaguaugucaggaguucaaaauuaaggaugguuacaggacuaaggaacaccccauccauucaauccagagguuuguuuggagccauugccgguuucauugaaggaggguggacuggaaugguagaugguugguaugguuaucaucaucagaaugagcaaggaucuggauaugcugcagaccaacaaagcacacaaaaugccauuaaugggauuacaaacaaggugaauucuguaauugaaaaaaugaacacucaauucacagcugugggcaaagaauucaacaaauuggaaagaagaauggaaaacuuaaauaaaaagauugaugauggguuucuagacauuuggacauauaaugcagaauuguuaguucuacuggaaaaugaaaggacuuuggauuuccaugacuccaacgugaagaaucuguaugagaaaguaaaaagccaauuaaaaaauaaugccaaagaaauaggaaacggguguuuugaauucuaucauaaguguaacgaugaaugcauggagagugugaaaaauggaacuuaugacuauccaaaauauuccgaagaaucaaaguuaaacagggagaaaauugauggagugaaauuggaaucaaugggagucuauaauauccuggcgaucuacucaacagucgccaguucccuaguucuuuuagucucccugggggcaaucagcuucuggauguguuccaaugggucuuuacaguguagaauaugcaucuaa

SEQ ID NO: 36872 - RNA, 1698 nt, Artificial Sequence
  hemagglutinin__InfluenzaA__ADV69109
augaaaguaaaacuacugauccuguuauguacauuuaaagcuacauaugcggacacaauauguauaggauaccaugccaacaacucaaccgaaacuguugacacaguacuugaaaagaaugugacagugacacacucugucaaccuacuugaggacagucacaaugggaagcugugccuacuaaagggaauagccccccuacaauuggguaauugcagcguugccggauggauauuaggaaacccagaaugcgaaucacugauuuccaagaaaucaugguccuacauuguagaaacaccaaauccugagaauggagcauguuauccaggggaguuugccgacuaugaggagcuaagggagcaauugaguucaguaucuucauuugagagauucgaaauauuccccaaagaaagcucauggcccaaccacacugcaaccggagugucagcgucaugcucccauaauggggaaagaaguuuuuacagaaaucugauauggcugacagugaaaaaugguuuguacccaaaccugagcaaguccuaugaaaacgacaaaaagaaagaaguccuuauacuaugggguguucaucauccgccuaacauagagaaccaaaggacccucuaucacacagaaaaugcuuaugucucuguagugucuucacauuauaguggaagauucaccccagaaauaaccaaaaggcccaaaguaagagaucaggaaggaagaaucaacuacuacuggacuuugcuggaacccggggauacaauaauauuugaggcaaauggaaaucuaauagcgccaugguaugcuuucacacugaguagaggccuuggaucaggaaucaucaccucuaaugcaccaauggacgaaugugaugcgaagugucaaacaccuaagggagcuauaaacagcagucuuccuuuccagaauguacacccagucacaauaggagaauguccaaaguaugucaggagugcaaaauuaaggaugguuacaggacuaaggaacaucccauccauucaauccagagguuuguuuggggccauugccgguuucauugaagggggguggacuggaaugguagaugggugguaugguuaucaucaucagaaugagcagggaucuggcuaugcugcagaucaagaaagcacacaaaaugccauuaacgggaucacaaacaaagugaauucuguaauugagaaaaugaacacucaauucacagcugugggcaaggaauucaacaaauuggaaagaaggauggagaacuuaaauaaaaagguugaugauggguuucuagacauuuggacauacaaugcagaguuguugguuuuacuggaaaaugaaagaacuuuggacuuccacgacuccaaugugaagagucuguacgagaaaguaaaaagccaauuaaagaauaaugcuaaagaaauagggaaugggugcuuugaauucuaucacaaguguaacaacgaaugcauggagagugugaaaaauggaacuuaugacuauccaaaauauuccgaagaaucaaaguuaaacagggaaaaaauugauggaguuaaauuggacucaaugggggucuaucggauucuggcgaucuacucaacugucgccaguucccuaguucuuuuggucucccugggggcaaucagcuucuggauguguuccaaugggucuuugcaauguagaauaugcaucuag

SEQ ID NO: 36873 - RNA, 1701 nt, Artificial Sequence
  hemagglutinin__InfluenzaA__ADV76579
augaagacuaucauugcuuugagcuacauucuaugucugguuuucgcucaaaaacuuccuggaaaugacgacagcacggcaacucugugccuugggcaccaugcaguaccaaacggaacgauagugaaaacaauaacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcauaaggagaucuaauaacaguuucuuuaguagauuaaauugguugacccacuuaagauucaaguacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacaccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucggaaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 36874 - RNA, 1701 nt, Artificial Sequence; identical to SEQ ID NO: 34092
  hemagglutinin__InfluenzaA__ADV76587

SEQ ID NO: 36875 - RNA, 1701 nt, Artificial Sequence; identical to SEQ ID NO: 34092
  hemagglutinin__InfluenzaA__ADV76598

SEQ ID NO: 36876 - RNA, 1701 nt, Artificial Sequence
  hemagglutinin__InfluenzaA__ADV76609
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaagccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 36877 - RNA, 1701 nt, Artificial Sequence
  hemagglutinin__InfluenzaA__ADV76620
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaagacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaaguggaaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagagguauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaauggaaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 36878 - RNA, 1701 nt, Artificial Sequence
  hemagglutinin__InfluenzaA__ADV76631
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaaugguaaaaccgggagacauacuuuugauuaacagcacagggaaucuaauugcuccuagggguuacuucaaaauacgaagugggaaaagcucaauaaugagaucagauacacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaauggaaagcugaauagauugaucgggaaagccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 36879 - RNA, 1701 nt, Artificial Sequence; identical to SEQ ID NO: 36096
  hemagglutinin__InfluenzaA__ADV76642

SEQ ID NO: 36880 - RNA, 1701 nt, Artificial Sequence; identical to SEQ ID NO: 36100
  hemagglutinin__InfluenzaA__ADV76664

SEQ ID NO: 36881 - RNA, 1701 nt, Artificial Sequence
  hemagglutinin__InfluenzaA__ADV76673
augaagaccaucauugcuuugagcuacauuuucugucuggcucucggccaagaccuuccaggaaaugacaacagcacagcaacgcugugccugggacaucaugcggugccaaacggaacacuagugaaaacaaucacagaugaucagauugaagugacuaaugcuacugagcuaguucagagcuccucaacggggaaaauaugcaacaauccucaucgaauccuugauggaauagacugcacacugauagaugcucuauugggggacccucauugugauguuuuucaaaaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguucaagcaucagggagagucacagucucuaccaggagaagccagcaaacuauaaucccgaauaucgaguccagacccuggguaaggggucugucuaguagaauaagcaucuauuggacaauaguuaauccgggagacguacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggcgcaaaagcagguuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaaggaggcaacugagggaaaaugcugaagacaugggcaaugguugcuucaaaauauaccacaaaugugacaacgcuugcauagagucaaucagaaaugggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 36882 - RNA, 1701 nt, Artificial Sequence
  hemagglutinin__InfluenzaA__ADV76682
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaaguggggaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaucacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 36883 - RNA, 1701 nt, Artificial Sequence
  hemagglutinin__InfluenzaA__ADV76694
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacagacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 36884 - RNA, 1701 nt, Artificial Sequence
  hemagglutinin__InfluenzaA__ADV76705
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucugacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 36885 - RNA, 1701 nt, Artificial Sequence; identical to SEQ ID NO: 34117
  hemagglutinin__InfluenzaA__ADV76716

SEQ ID NO: 36886 - RNA, 1701 nt, Artificial Sequence
  hemagglutinin__InfluenzaA__ADV76727
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaaaaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaaguggaaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 36887 - RNA, 1701 nt, Artificial Sequence
  hemagglutinin__InfluenzaA__ADV91009
augaaggcaauacuagcaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggauagccccauugcauuuggguaaauguaacauugcuggcuggauccugggaaauccagagugugaaucacucuccacagcaagcucaugguccuacauuguggaaacaccuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaaaaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugccagacacccaagggugcuauaaacaccagccucccauuucagaauauacauccgaucacaauuggaaaauguccaaaauauguagaaagcacaaaauugagacuggccacaggauugaggaaugucccgucuauucaaucuagaggccuauuuggggccauugccgguuucauugaagggggguggacaggaaugguagauggaugguacgguuaucaccaucaaaaugagcaggggucaggauaugcagccgacuugaagagcacacagaaugccauugacaagauuacuaacaaaguaaauucugucauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaaaguaagaagucaguuaaaaaacaaugccaaggaaauuggaaacggcugcuuugaauuuuaccacaaaugcgauaacacgugcauggaaagugucaaaaaugggacuuaugacuacccaaaauacucagaagaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36888 - RNA, 1701 nt, Artificial Sequence
  hemagglutinin__InfluenzaA__ADV91010
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaccgauuaugaggagcuaagagagcaauugagcucagugucaucauuugaaagguuugagauauuccccaagacaaguucauggcccaaucaugacucgaacaaagguguaacgacagcauguccucaugcuggagcaaaaagcuucuacaaaaauuuaauauggcuaguuaaaaaaggaaauucauacccaaaacucagcaaauccuacauuaaugauaaagggaaagaaguccucgugcuauggggcauucaccauccaccuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccuuccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggguaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugugauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36889 - RNA, 1701 nt, Artificial Sequence
  hemagglutinin__InfluenzaA__ADW01407
auggaagcaaaauuauuuguauuauucugugcauucacugcacuaaaagcugacaccauuuguguaggcuaccaugccaacaauuccacagacacugucgacacaauacuggagaaaaaugugacuguuacccauucaguuaauuuacuggaaaacagccauaaugggaaacucugcagccugaauggaaagauccccuuacaacuggggaacugcaacguagcaggauggauccuuggcaacccaaaaugugacuugcugcucacagcgaauucguggucuuacauaauagagacuucaaauucaaaaaauggagcaugcuaccccggagaauucgcugauuaugaagaguuaaaggagcagcugaguacaguuucuucauuugaaagauuugaaauuuucccaaaggcaaccucauggccaaaccaugauaccaccagagguaccacaguugcaugcucccacucuggagccaacagcuuuuaucggaauuuacuauggauaguaaagaaaggaaacuccuauccuaagcucagcaagucauacacaaacaauaagggaaaggaagugcuuguaauuuggggagugcaccacccuccgaccgacagugaccaacaaacccucuaccagaauaaucauacauauguuucaguuggaucaucaaaauacuacaaaaggcucacaccagaaauaguagcaagaccuaaagucagagaacaagcaggcagaaugaauuauuacuggacacuguuagaucaaggggacaccauaacuuuugaagccacugggaauuuaauagcaccauggcacgcauuugcauugaaaaaaggcucuaguucuggaauuaugaggucggaugcucagguucacaauugcacuacaaagugccaaacuccccauggggccuugaaaggcaaucuuccuuuucagaauguacaucccgucacuauuggagaaugccccaaauauguuaaaagcacccaacugagaauggcaacaggacuaaggaauauccccucuauucaauccagaggacuuuucggggcaauugccggauucauugaaggaggauggacaggaaugguagauggaugguauggauaucaccaucgaaaugagcagggaucugguuacgcagcagaucagaaaagcacacaaauugcaauugaugggauaaguaacaaagugaacucagugauugaaaaaaugaacauucaauuuacuucagugggcaaggaguucaauagucuagagaaaaggauggaaaauuugaauaagaagguugaugauggguuuuuggauguauggacauauaacgcugaguugcucauuuuacucgagaaugaaaggacucuagauuuccaugaccuuaacguaaaaaauuuauaugaaaaggucaaaucacaacuaaggaacaaugccaaggaaaucggaaauggcugcuuugaguucuaucacaaaugugauaaugagugcauggaaagcguaaagaauggcacauacaauuaucccaaauauucagaagaauccaaauuaaauagggaggaaauagauggugugaaacuagaaucaaugggaauucaccagauuuuggcgaucuacuccacagucgccaguucccuggucuuauuagucucccugggggcaaucagcuucuggauguguucuaaugggucauugcaaugcagaguaugcauuuaa

SEQ ID NO: 36890 - RNA, 1698 nt, Artificial Sequence
  hemagglutinin__InfluenzaA__ADW09101
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaacuugagcaaguccuaugcaaacaacaaagaaaaagaaguccuuguacuaugggguguucaucacccgccaaacauaguugaccaaaagacccucuaucguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36891 - RNA, 1698 nt, Artificial Sequence
  hemagglutinin__InfluenzaA__ADW09111
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuauguuuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaaguucauggcccaaccacaccguaaccggagugucagcaucaugcucccauaauggggaaagcaguuuuuacagaaauuugcuauggcugacggggaagaaugguuuguacccaaacuugagcaaguccuaugcaaacaacaaagaaaaagaaguccuuguacuaugggguguucaucacccgccaaacauaguugaccaaaagacccucuaucguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucggggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugaucaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaaccuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36892 - RNA, 1698 nt, Artificial Sequence
  hemagglutinin__InfluenzaA__ADW09120
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuauguuuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggugaagaaugguuuguacccaaacuugagcaaguccuaugcaaacaacaaagaaaaagaaguccuuguacuaugggguguucaucacccgccaaacauaguugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguaaaggcuuuggaucaggaaucaucaacucaaaugcaccaauggauaaaugugaugcgaagugccaaacaccucggggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagguggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaaccuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36893 - RNA, 1698 nt, Artificial Sequence
  hemagglutinin__InfluenzaA__ADW09131
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaaugggaaacuauguuuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggugaagaaugguuuguacccaaacuugagcaaguccuaugcaaacaacaaagaaaaagaaguccuuguacuaugggguguucaucacccgccaaacauaguugaccaaaagacccucuaucguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucggggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaaccuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36894 - RNA, 1698 nt, Artificial Sequence
  hemagglutinin__InfluenzaA__ADW09153
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaaugggaaacuauguuuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggugaagaaugguuuguacccaaacuugagcaaguccuaugcaaacaacaaagaaaaagaaguccuuguacuaugggguguucaucacccgccaaacauaguugaccaaaagacccucuaucguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucggggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaagaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggacuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaaccuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36895 - RNA, 1698 nt, Artificial Sequence; identical to SEQ ID NO: 36893
  hemagglutinin__InfluenzaA__ADW09164

SEQ ID NO: 36896 - RNA, 1698 nt, Artificial Sequence
  hemagglutinin__InfluenzaA__ADW09186
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaacuugagcaaguccuaugcaaacaacaaagaaaaagaaguccuuguacuaugggguguucaucacccgccaaacauaguugaccaaaagacccucuaucguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaccccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36897 - RNA, 1698 nt, Artificial Sequence
  hemagglutinin__InfluenzaA__ADW09197
augaaagugaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaacuugagcaaguccuaugcaaacaacaaagaaaaagaaguccuuguacuaugggguguucaucacccgccaaacauaguugaccaaaagacccucuaucguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36898 - RNA, 1698 nt, Artificial Sequence; identical to SEQ ID NO: 36893
  hemagglutinin__InfluenzaA__ADW09208

SEQ ID NO: 36899 - RNA, 1698 nt, Artificial Sequence; identical to SEQ ID NO: 36893
  hemagglutinin__InfluenzaA__ADW09219

SEQ ID NO: 36900 - RNA, 1698 nt, Artificial Sequence; identical to SEQ ID NO: 36890
  hemagglutinin__InfluenzaA__ADW09230

SEQ ID NO: 36901 - RNA, 1698 nt, Artificial Sequence
  hemagglutinin__InfluenzaA__ADW09241
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaaugggaaacuauguuuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaaaugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggugaagaaugguuuguacccaaacuugagcaaguccuaugcaaacaacaaagaaaaagaaguccuuguacuaugggguguucaucacccgccaaacauaguugaccaaaagacccucuaucguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucggggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaaccuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36902 - RNA, 1698 nt, Artificial Sequence; identical to SEQ ID NO: 36893
  hemagglutinin__InfluenzaA__ADW09252

SEQ ID NO: 36903 - RNA, 1698 nt, Artificial Sequence
  hemagglutinin__InfluenzaA__ADW09274
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaaugggaaacuauguuuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggugaagaaugguuuguacccaaacuugagcaagcccuaugcaaacaacaaagaaaaagaaguccuuguacuaugggguguucaucacccgccaaacauaguugaccaaaagacccucuaucguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucggggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaaccuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36904 - RNA, 1698 nt, Artificial Sequence
  hemagglutinin__InfluenzaA__ADW09285
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaacuugagcaaguccuaugcaaacaacaaagaaaaagaaguccuuguacuaugggguguucaucacccgccaaacauaguugaccaaaagacccucuaucguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaacauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36905 - RNA, 1698 nt, Artificial Sequence
  hemagglutinin__InfluenzaA__ADW09296
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaaugggaaacuauguuuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggugaagaaugguuuguacccaaacuugagcaaguccuaugcaaacaacaaagaaaaagaaguccuuguacuaugggguguucaucacccgccaaacauaguugaccaaaagacccucuaucguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucggggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaauggaauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaaccuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36906 - RNA, 1698 nt, Artificial Sequence; identical to SEQ ID NO: 36890
  hemagglutinin__InfluenzaA__ADW09307

SEQ ID NO: 36907 - RNA, 1698 nt, Artificial Sequence
  hemagglutinin__InfluenzaA__ADW09327
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaguugaccaaaagacccucuaucguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaaaugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacaaugaaugcauggagaguguaaagaauggaacuuaugacuauccaaaauauuccgaagaaucaaaauuaaacagggagaaaauugauggagugaaauuggagucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36908 - RNA, 1698 nt, Artificial Sequence; identical to SEQ ID NO: 36893
  hemagglutinin__InfluenzaA__ADW10483

SEQ ID NO: 36909 - RNA, 1698 nt, Artificial Sequence
  hemagglutinin__InfluenzaA__ADW10494
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaacuugagcaaguccuaugcaaacaacaaagaaaaagaaguccuuguacuaugggguguucaucacccgccaaacauaguugaccaaaagacccucuaucguacagaaaaugcuuauguuucuguagugucuucacauuauagcagaaaauucaccccagaaauagccaaaagacccaaaguaagagaucaagaaggaagaaucaacuauuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaaaccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36910 - RNA, 1698 nt, Artificial Sequence; identical to SEQ ID NO: 36893
  hemagglutinin__InfluenzaA__ADW10505

SEQ ID NO: 36911 - RNA, 1698 nt, Artificial Sequence
  hemagglutinin__InfluenzaA__ADW10516
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuauguuuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggugaagaaugguuuguacccaaacuugagcaaguccuaugcaaacaacaaagaaaaagaaguccuuguacuaugggguguucaucacccgccaaacauaguugaccaaaagacccucuaucguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccgagauaugcuuucgcacugaguagaggcuuuggaucaggaaucaucaacucaaaugcaccaauggauaaaugugaugcgaagugccaaacaccucggggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaaccuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36912 - RNA, 1698 nt, Artificial Sequence
  hemagglutinin__InfluenzaA__ADW10527
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaacuugagcaaguccuaugcaaacaacaaagaaaaagaaguccuuguacuaugggguguucaucacccgccaaacauaguugaccaaaagacccucuaucguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggauuaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36913 - RNA, 1698 nt, Artificial Sequence
  hemagglutinin__InfluenzaA__ADW10538
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaacuugagcaaguccuaugcaaacaacaaagaaaaagaaguccuuguacuaugggguguucaucacccgccaaacauaguugaccaaaagacccucuaucguacagaaaaugcuuauguuucuguaaugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36914 - RNA, 1698 nt, Artificial Sequence
  hemagglutinin__InfluenzaA__ADW10549
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaaugggaaacuauguuuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggugaagaaugguuuguacccaaacuugagcaaguccuaugcaaacaacaaagaaaaagaaguccuuguacuaugggguguucaucacccgccaaacauaguugaccaaaagacccucuaucguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucggggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaaugaugaaugcauggagaguguaaagaauggaaccuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36915 - RNA, 1698 nt, Artificial Sequence
  hemagglutinin__InfluenzaA__ADW10560
augaaaguaaaacuacugguccuguuaugcacauuuacagcuacauaugcagacacaauauguauaggcuaccaugcuaacaacucgaccgacacuguugacacaguauuugaaaagaauguuacagugacacacucugucaaccugcuugagaacagucacaauggaaaacugugucuauuaaaaggaauagccccacuacaauuggguaacugcagcguugccggguggaucuuaggaaauccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagaaguuuuuacagaaauuugcuauggcugacggggaagaaugguuuguacccaaaccugagcaaguccuaugcaaacaacaaagaaaaagaaguccuuguacuaugggguguucaucacccgccagacauaggugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacuggacuaaggaacaucccauccauucaauccagagguuuguuuggagccauugccgguuucauugaagggggguggacuggaaugguagaugguugguaugguuaucaucaucagaaugagcaagggucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugauuccaaugugaagaaucuguaugagaaaguaaaaagccaguuaaagaauaaugcuaaagaaauaggaaauggguguuuugaauucuaucacaaguguaacgaugagugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucuuguucuuuuggucucccugggggcaaucaguuucuggauguguuccaaugggucuuugcaguguagaauaugcaucuaa

SEQ ID NO: 36916 - RNA, 1698 nt, Artificial Sequence
  hemagglutinin__InfluenzaA__ADW10571
augaaaguaaaacuacugguccuguuaugcacauuuacagcuacauaugcagacacaauauguauuggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccaggacauuucgcugacuaugaggaacugagggagcaauugaguucaguaucuucauuugagagguucgaaauauuccccaaagaaagcucauggcccaaccacaccguaaccggagugucagcaucaugcucccauaauggggaaaacaguuuuuacagaaauuugcuauggcugacggggaagaaugguuuguacccaaaccugagcaaguccuaugcaaacaacaaagaaaaagaaguccuuguacuaugggguguucaucacccgccaaacauggcugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucaaggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36917 - RNA, 1698 nt, Artificial Sequence
  hemagglutinin__InfluenzaA__ADW10582
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaagagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaguugaccaaaagacccucuaucguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36918 - RNA, 1698 nt, Artificial Sequence; identical to SEQ ID NO: 36893
  hemagglutinin__InfluenzaA__ADW10593

SEQ ID NO: 36919 - RNA, 1698 nt, Artificial Sequence
  hemagglutinin__InfluenzaA__ADW10604
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaaugggaaacuauguuuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggugaagaaugguuuguacccaaacuugagcaaguccuaugcaaacaacaaagaaaaagaaguccuuguacuaugggguguucaucacccgccaaacauaguugaccaaaagacccucuaucguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucggggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugaaaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaaccuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36920 - RNA, 1698 nt, Artificial Sequence
  hemagglutinin__InfluenzaA__ADW10615
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaaugggaaacuauguuuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaacugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggugaagaaugguuuguacccaaacuugagcaaguccuaugcaaacaacaaagaaaaagaaguccuuguacuaugggguguucaucacccgccaaacauaguugaccaaaagacccucuaucguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucggggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaaccuacgacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36921 - RNA, 1698 nt, Artificial Sequence
  hemagglutinin__InfluenzaA__ADW10626
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaaugggaaacuauguuuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggugaagaaugguuuguacccaaacuugagcaaguccuaugcaaacaacaaagaaaaagaaguccuuguacuaugggguguucaucacccgccaagcauaguugaccaaaagacccucuaucguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucggggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaaccuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36922 - RNA, 1698 nt, Artificial Sequence
  hemagglutinin__InfluenzaA__ADW10721
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuauguuuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuuaagagguucgaaauauuccccaaagaaagcucauggcccaaccacaccguaaccggagugucagcaucaugcucccauaauggggaaagcaguuuuuacagaaauuugcuauggcugacggugaagaaugguuuguacccaaacuugagcaaguccuaugcaaacaacaaagaaaaagaaguccuuguacuaugggguguucaucacccgccaaacauaguugaccaaaggacccucuaucauacagaaaaugcuuauguuucuguagugucuucacauuauagcagaaaauucaccccagaaauagccaaaagacccaaaguaagaaaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucggggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaaccuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36923 - RNA, 1698 nt, Artificial Sequence
  hemagglutinin__InfluenzaA__ADW10743
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaaugggaaacuauguuuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggugaagaaugguuuguacccaaacuugagcaaguccuaugcaaacaacaaagaaaaagaaguccuuguacuaugggguguucaucacccgccaaacauaguugaccaaaagacccucuaucguacagaaaauacuuauguuucuguagugucuucacauuauagcagaaaauucaccccagaaauagccaaaagacccaaaauaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucggggagcuauaaacagcagucuuccuuuccagaacguacacccagucacaauaggagaguguccaaaguaugucaggaguguaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaaccuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36924 - RNA, 1698 nt, Artificial Sequence
  hemagglutinin__InfluenzaA__ADW10754
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucacauaauggggaaaacaguuuuuacagaaauuugcuauggcugacggggaagaaugguuuguacccaaaccugagcaaguccuaugcaaacaacaaagaaaaagaaguccuuguacuaugggguguucaucacccgccaaacauagcugaccaaaagacccucuaucauacagaaaaugcuuauguuucuguagugucuucacauuacagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucaaggagcuauaaacagcagucuuccuuuccagaacguacacccagucacaauaggagaguguccaaaguaugucaggagugcaaaauuaaggaugguuacaggacuaaggaacaucccauccguucaauccagagguuuguuuggagccauugccgguuucauugaagggggguggacuggaaugguagaugguugguaugguuaucaucaucagaaugaacaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36925 - RNA, 1698 nt, Artificial Sequence
  hemagglutinin__InfluenzaA__ADW10765
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuauguuuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggugaagaaugguuuguacccaaacuugagcaaguccuaugcaaacaacaaagaaaaagaaguccuuguacuaugggguguucaucacccgccaaacauaguugaccaaaagacccucuaucauacagaaaaugcuuauguuucuguagugucuucacauuauagcagaaaauucaccccagaaauagccaaaagacccaaaguaagaaaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucggggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaaccuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36926 - RNA, 1698 nt, Artificial Sequence
  hemagglutinin__InfluenzaA__ADW10776
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaacuugagcaaguccuaugcaaacgacaaagaaaaagaaguccuuguacuaugggguguucaucacccgccaaacauaguugaccaaaagacccucuaucguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36927 - RNA, 1698 nt, Artificial Sequence
  hemagglutinin__InfluenzaA__ADW10787
augaaaguaaaaauacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuauguuuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggugaagaaugguuuguacccaaacuugagcaaguccuaugcaaacaacaaagaaaaagaaguccuuguacuaugggguguucaucacccgccaaacauaguugaccaaaagacccucuaucguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccgagauaugcuuucgcacugaguagaggcuuuggaucaggaaucaucaacucaaaugcaccaauggauaaaugugaugcgaagugccaaacaccucggggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaguucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaaccuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36928 - RNA, 1698 nt, Artificial Sequence
  hemagglutinin__InfluenzaA__ADW10798
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaagagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagagaaagaaguccuuguacuaugggguguucaucacccgccaaacauaguugaccaaaagacccucuaccguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggguaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggguggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36929 - RNA, 1698 nt, Artificial Sequence; identical to SEQ ID NO: 36925
  hemagglutinin__InfluenzaA__ADW10809

SEQ ID NO: 36930 - RNA, 1698 nt, Artificial Sequence; identical to SEQ ID NO: 36893
  hemagglutinin__InfluenzaA__ADW10820

SEQ ID NO: 36931 - RNA, 1698 nt, Artificial Sequence; identical to SEQ ID NO: 36890
  hemagglutinin__InfluenzaA__ADW10831

SEQ ID NO: 36932 - RNA, 1698 nt, Artificial Sequence
  hemagglutinin__InfluenzaA__ADW10842
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaaugggaaacuauguuuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggugaagaaugguuuguacccaaacuugagcaaguccuaugcaaacaacaaagaaaaagaaguccuuguacuaugggguguucaucacccgccaaacauaguugaccaaaagacccucuaucguacagaaaaugcuuauguuucuguagugucuucacauuauagcagaaaauucgccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucggggagcuauaaacagcagucuuccuuuccagaacguacauccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaaccuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36933 - RNA, 1698 nt, Artificial Sequence
  hemagglutinin__InfluenzaA__ADW10853
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacugugucuauuaaaaggaauagccccacuacaauuggguaacugcagcguugccggguggaucuuaggaaauccagaaugcgaauuacugauuuccaaggaaucaugguccuacauuguagaaaaaccaaacccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagaaguuuuuacagaaauuugcuauggcugacggggaagaaugguuuguacccaaaccugagcaaguccuaugcaaacaacaaagaaaaagaaguccuuguacuaugggguguucaucacccgccagacauaggugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacuggacuaaggaacaucccauccauucaauccagagguuuguuuggagccauugccgguuucauugaagggggguggacuggaaugguagaugguugguaugguuaucaucaucagaaugagcaagggucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugauuccaaugugaagaaucuguaugagaaaguaaaaagccaguuaaagaauaaugcuaaagaaauaggaaauggguguuuugaauucuaucacaaguguaacgaugagugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucaguuucuggauguguuccaaugggucuuugcaguguagaauaugcaucuaa

SEQ ID NO: 36934 - RNA, 1698 nt, Artificial Sequence; identical to SEQ ID NO: 36925
  hemagglutinin__InfluenzaA__ADW10864

SEQ ID NO: 36935 - RNA, 1698 nt, Artificial Sequence
  hemagglutinin__InfluenzaA__ADW10875
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugcuuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggugaagaaugguuuguacccaaacuugagcaaguccuaugcaaacaacaaagaaaaagaaguccuuguacuaugggguguucaucacccgccaaacauaguugaccaaaagacccucuaucauacagaaaaugcuuauguuucuguagugucuucacauuauagcagaaaauucaccccagaaauagccaaaagacccaaaguaagaaaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucggggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaaccuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36936 - RNA, 1698 nt, Artificial Sequence; identical to SEQ ID NO: 36893
  hemagglutinin__InfluenzaA__ADW10886

SEQ ID NO: 36937 - RNA, 1698 nt, Artificial Sequence
  hemagglutinin__InfluenzaA__ADW10897
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaucacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaagcauaagugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugauacgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacccaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaguaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 36938 - RNA, 1701 nt, Artificial Sequence
  hemagglutinin__InfluenzaA__ADW23115
augaagacuaucauugcuuugagcuacauucuaugucugguuuucgcucaaaaacuuccuggaaauggcaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccauaugaugugccggauuaugccucccuuaggucacuaguugccucauccggcacacuggaguuuaacaaugaaagcuucaauuggacuggagucacccaaaacggaacaagcucugcuugcauaaggagaucuaauaacaguuucuuuaguagauugaauugguugacccacucaaaauucaaauacccagcauugaacgugacuaugccaaacaaugaacaauuugacaaauuguacauuugggggguucaccacccggguacggacaaugaccaaaucuuccuguaugcucaagcaucaggaagaaucacaguaucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauccaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauugaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 36939 - RNA, 1701 nt, Artificial Sequence
  hemagglutinin__InfluenzaA__ADW54481
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggguugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 36940 - RNA, 1701 nt, Artificial Sequence
  hemagglutinin__InfluenzaA__ADW54512
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuuaaaagguuugagauauuccccaagacaaguucauggcccaaucaugacucgaacaaagguguaacgacagcauguccucaugcuggagcaaaaagcuucuacaaaaauuuaauauggcuaguuaaaaaaggaaauucauacccaaaacucagcaaauccuacauuaaugauaaagggaaagaaguccucgugcuauggggcauucaccauccaccuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccuuccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggguaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugugauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36941 - RNA, 1701 nt, Artificial Sequence
  hemagglutinin__InfluenzaA__ADW54527
augaaggcaauacuaguaguucugcuauauacauuugcaaccgcaagugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacgacagcauguccucaugcuggagcaaaaagcuucuacaaaaacuuaauauggcuaguuaaaaaaggaaauucauacccaaaacucagcaaauccuacauuaaugacaaagggaaagaaguccucgugcuauggggcauucaccauccaccuacuagugcugaccaacaaagucucuaucagaaugcagaugcauauguuuuuguggggacaucaagauacagcaagaaguucaagccggaaauagcaauaagacccaaagugagggaucaagaagggaggaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaauggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggguaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugugauaacacgugcauggaaagugucaaaaaugggacuuaugacuacccaaaauacucagaggaagcaaaauuaaacagagaagaaauagaugggguaaaacuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36942 - RNA, 1701 nt, Artificial Sequence
  hemagglutinin__InfluenzaA__ADW65825
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 36943 - RNA, 1701 nt, Artificial Sequence
  hemagglutinin__InfluenzaA__ADW82135
augaagacuaucauugcuuugagcuacauucuaugucugguuuucgcucaaaaacuuccuggaaaugacaacagcacggcaacgcugugccuugggcaccaugcaguaccaaacggaacgguagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacugguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacacagcauugaacgugacuaugccaaacaaugaacaauuugacaaauuguacauuugggggguucaccacccgggcacggacaaagaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 36944 - RNA, 1701 nt, Artificial Sequence; identical to SEQ ID NO: 36943
  hemagglutinin__InfluenzaA__ADW82155

SEQ ID NO: 36945 - RNA, 1701 nt, Artificial Sequence; identical to SEQ ID NO: 36943
  hemagglutinin__InfluenzaA__ADW82166

SEQ ID NO: 36946 - RNA, 1701 nt, Artificial Sequence; identical to SEQ ID NO: 36943
  hemagglutinin__InfluenzaA__ADW82177

SEQ ID NO: 36947 - RNA, 1701 nt, Artificial Sequence
  hemagglutinin__InfluenzaA__ADW82188
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaaugucccaaauauguaaaaagcacaaaauuaagacuggccacaggauugaggaaugucccuucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgaaauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36948 - RNA, 1701 nt, Artificial Sequence; identical to SEQ ID NO: 36947
  hemagglutinin__InfluenzaA__ADW82198

SEQ ID NO: 36949 - RNA, 1701 nt, Artificial Sequence; identical to SEQ ID NO: 36947
  hemagglutinin__InfluenzaA__ADW82208

SEQ ID NO: 36950 - RNA, 1701 nt, Artificial Sequence; identical to SEQ ID NO: 36947
  hemagglutinin__InfluenzaA__ADW82218

SEQ ID NO: 36951 - RNA, 1701 nt, Artificial Sequence; identical to SEQ ID NO: 36947
  hemagglutinin__InfluenzaA__ADW82228

SEQ ID NO: 36952 - RNA, 1701 nt, Artificial Sequence; identical to SEQ ID NO: 36947
  hemagglutinin__InfluenzaA__ADW82238

SEQ ID NO: 36953 - RNA, 1701 nt, Artificial Sequence; identical to SEQ ID NO: 36947
  hemagglutinin__InfluenzaA__ADW82248

SEQ ID NO: 36954 - RNA, 1701 nt, Artificial Sequence; identical to SEQ ID NO: 36947
  hemagglutinin__InfluenzaA__ADW82258

SEQ ID NO: 36955 - RNA, 1701 nt, Artificial Sequence
  hemagglutinin__InfluenzaA__ADW82268
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacugagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguccuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauucaccagauuuuggcgauuuauucaacugucgccaguucauugguacugguagucucccugggggcaaucaguuucuggaugugcucuaaugggucucuacaguguagaauauguauuuaa

SEQ ID NO: 36956 - RNA, 1701 nt, Artificial Sequence; identical to SEQ ID NO: 36943
  hemagglutinin__InfluenzaA__ADW93760

SEQ ID NO: 36957 - RNA, 1701 nt, Artificial Sequence
  hemagglutinin__InfluenzaA__ADW95319
augaaggcaauacuaguaguucugcuauauacauuugcaaccgcaaaugcagacacauuauguauagguuaccaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauuaagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacaccaaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacgcaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 36958 - RNA, 1701 nt, Artificial Sequence
  hemagglutinin__InfluenzaA__ADW95332
augaaggcaauacuaguaguucugcuauauacauuugcaaccgcaaaugcagacacauuauguauagguuaccaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauuaagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 36959 - RNA, 1701 nt, Artificial Sequence
  hemagglutinin__InfluenzaA__ADX21078
augaagacuaucauugcuuugagcuacauucuaugucugguuuucgcucaaaaacuuccuggaaaugacaacagcacggcaacgcugugccuugggcaccaugcaguaccaaacggaacgguagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacugguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacacagcauugaacgugacuaugccaaacaaugaacaauuugacaaauuguacauuugggggguucaccacccgggcacggacaaagaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucaggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 36960 - RNA, 1701 nt, Artificial Sequence; identical to SEQ ID NO: 36959
  hemagglutinin__InfluenzaA__ADX21088

SEQ ID NO: 36961 - RNA, 1701 nt, Artificial Sequence
  hemagglutinin__InfluenzaA__ADX21098
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacugagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaguacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguccuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauucaccagauuuuggcgauuuauucaacugucgccaguucauugguacugguagucucccugggggcaaucaguuucuggaugugcucuaaugggucucuacaguguagaauauguauuuaa

SEQ ID NO: 36962 - RNA, 1701 nt, Artificial Sequence; identical to SEQ ID NO: 34094
  hemagglutinin__InfluenzaA__ADX36109

SEQ ID NO: 36963 - RNA, 1701 nt, Artificial Sequence
  hemagglutinin__InfluenzaA__ADX96278
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauuuggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauuagacccaaagugagggaucaagaagggagaaugaacuauuacuggacacuaguagagccgggagacaaaauaacauucgaagcaacuggaaaucuagugguaccaagauaugcauucgcaauggaaagaaaugcuggaucugguauuaucauuucagauacaccaguccaugauugcaauacaacuugucagacacccaagggugcuguaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagcugaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaguuggaaacggcugcuuugaauuuuaucacaaaugcgauaacacgugcauggaaagugucaaaaaugggacuuaugacuacccaaaauacucagaggaagcaaaauuaaacagagaagaaauagaugggguaaagcuggagucaacaaggauuuaccagauuuuggcgaucuauucaacugccgccaguucauugguacugguagucucccugggggcaaucaguuucuggaugugcucuaaugggucucuacaguguagaauauguauuuaa

SEQ ID NO: 36964 - RNA, 1701 nt, Artificial Sequence
  hemagglutinin__InfluenzaA__ADX96288
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauuuggcuaguuaaacaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauuagacccaaagugagggaucaagaagggagaaugaacuauuacuggacacuaguagagccgggagacaaaauaacauucgaagcaacuggaaaucuagugguaccaagauaugcauucgcaauggaaagaaaugcuggaucugguauuaucauuucagauacaccaguccaugauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaguuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuucuggaugugcucuaaugggucucuacaguguagaauauguauuuaa

SEQ ID NO: 36965 - RNA, 1701 nt, Artificial Sequence
  hemagglutinin__InfluenzaA__ADX96298
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauaguaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccaugauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuacugggucucuacaguguagaauauguauuuaa

SEQ ID NO: 36966 - RNA, 1701 nt, Artificial Sequence
  hemagglutinin__InfluenzaA__ADX96308
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaacucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcagggaucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccaugauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36967 - RNA, 1701 nt, Artificial Sequence
  hemagglutinin__InfluenzaA__ADX96318
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucaaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauucauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaucagauuuuggcgaucuauucaacugucgccaguucauugguacugguagucucccugggggcaaucaguuucuggaugugcucuaaugggucucuacaguguagaauauguauuuaa

SEQ ID NO: 36968 - RNA, 1701 nt, Artificial Sequence
  hemagglutinin__InfluenzaA__ADX96328
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucaaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuaguggcaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36969 - RNA, 1701 nt, Artificial Sequence
  hemagglutinin__InfluenzaA__ADX96347
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacaauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36970 - RNA, 1701 nt, Artificial Sequence
  hemagglutinin__InfluenzaA__ADX96357
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauaguaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggcuauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36971 - RNA, 1701 nt, Artificial Sequence
  hemagglutinin__InfluenzaA__ADX96367
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccuagugcuauggggcauucaccauccaucuacuagugcugaccaacaaagucucuaucagaaugcagaugcauauguuuuuguggggacaucaagauacagcaagaaguucaagccggaaauaguaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36972 - RNA, 1701 nt, Artificial Sequence
  hemagglutinin__InfluenzaA__ADX96378
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaauccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguaugguuaucaccaucaaaaugagcaggggucaggauaugcagccgaccugaagagcacacagaaugccauugacgagauuacuaacaaaguaaauucuguuauugaaaagaugaacacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36973 - RNA, 1701 nt, Artificial Sequence
  hemagglutinin__InfluenzaA__ADX96398
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaauccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaacacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36974 - RNA, 1701 nt, Artificial Sequence
  hemagglutinin__InfluenzaA__ADX96408
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaauccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36975 - RNA, 1701 nt, Artificial Sequence
  hemagglutinin__InfluenzaA__ADX96427
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauuuggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccaugauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaguuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucuuugcaguguagaauaugcauuuaa

SEQ ID NO: 36976 - RNA, 1701 nt, Artificial Sequence
  hemagglutinin__InfluenzaA__ADX96437
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauuuggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauuagacccaaagugagggaucaagaagggagaaugaacuauuacuggacacuaguagagccgggagacaaaauaacauucgaagcaacuggaaaucuagugguaccaagauaugcauucgcaauggaaagaaaugcuggaucugguauuaucauuucagauacaccaguccaugauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagacuagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaguuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuucuggaugugcucuaaugggucucuacaguguagaauauguauuuaa

SEQ ID NO: 36977 - RNA, 1701 nt, Artificial Sequence
  hemagglutinin__InfluenzaA__ADX96447
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugguucucuacaguguagaauauguauuuaa

SEQ ID NO: 36978 - RNA, 1701 nt, Artificial Sequence
  hemagglutinin__InfluenzaA__ADX96497
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguaugguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucuuuacaguguagaauauguauuuaa

SEQ ID NO: 36979 - RNA, 1701 nt, Artificial Sequence
  hemagglutinin__InfluenzaA__ADX96507
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuacugggucuuuacaguguagaauauguauuuaa

SEQ ID NO: 36980 - RNA, 1701 nt, Artificial Sequence
  hemagglutinin__InfluenzaA__ADX96517
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaacacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuacugggucuuuacaguguagaauauguauuuaa

SEQ ID NO: 36981 - RNA, 1701 nt, Artificial Sequence
  hemagglutinin__InfluenzaA__ADX96527
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaacacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuuccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36982 - RNA, 1701 nt, Artificial Sequence; identical to SEQ ID NO: 33173
  hemagglutinin__InfluenzaA__ADX96537

SEQ ID NO: 36983 - RNA, 1701 nt, Artificial Sequence
  hemagglutinin__InfluenzaA__ADX96547
augaaggcaauacuaguaguucugcuauauacauuugcaaccgcaaaugcagacacauuauguauagguuaucaugcgaacaauucaacagacacuguagacacgguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauacgcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaacacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucagcuucuggauguguuccaaugggucuuugcaguguagaauaugcauuuaa

SEQ ID NO: 36984 - RNA, 1701 nt, Artificial Sequence
  hemagglutinin__InfluenzaA__ADX96557
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36985 - RNA, 1701 nt, Artificial Sequence; identical to SEQ ID NO: 33173
  hemagglutinin__InfluenzaA__ADX96587

SEQ ID NO: 36986 - RNA, 1701 nt, Artificial Sequence; identical to SEQ ID NO: 33197
  hemagglutinin__InfluenzaA__ADX96597

SEQ ID NO: 36987 - RNA, 1701 nt, Artificial Sequence
  hemagglutinin__InfluenzaA__ADX96607
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaccaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36988 - RNA, 1701 nt, Artificial Sequence
  hemagglutinin__InfluenzaA__ADX96627
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaaaaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuacugggucucuacaguguagaauauguauuuaa

SEQ ID NO: 36989 - RNA, 1701 nt, Artificial Sequence; identical to SEQ ID NO: 33620
  hemagglutinin__InfluenzaA__ADX96637

SEQ ID NO: 36990 - RNA, 1701 nt, Artificial Sequence
  hemagglutinin__InfluenzaA__ADX96647
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugguucucuacaguguagaauauguauuuaa

SEQ ID NO: 36991 - RNA, 1701 nt, Artificial Sequence
  hemagglutinin__InfluenzaA__ADX96657
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauauagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccuaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacgcaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucgaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36992 - RNA, 1701 nt, Artificial Sequence; identical to SEQ ID NO: 33206
  hemagglutinin__InfluenzaA__ADX96667

SEQ ID NO: 36993 - RNA, 1701 nt, Artificial Sequence
  hemagglutinin__InfluenzaA__ADX96677
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacaguaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36994 - RNA, 1701 nt, Artificial Sequence
  hemagglutinin__InfluenzaA__ADX96687
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuuaaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccagucuacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36995 - RNA, 1701 nt, Artificial Sequence
  hemagglutinin__InfluenzaA__ADX96697
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaauucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36996 - RNA, 1701 nt, Artificial Sequence
  hemagglutinin__InfluenzaA__ADX96707
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcgauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuacugggucucuacaguguagaauauguauuuaa

SEQ ID NO: 36997 - RNA, 1701 nt, Artificial Sequence
  hemagglutinin__InfluenzaA__ADX96727
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauguuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuagaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 36998 - RNA, 1701 nt, Artificial Sequence
  hemagglutinin__InfluenzaA__ADX96737
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugaaggaacaagaagggagaaugaacuauuacuggacacuaguagagccgggagacaaaauaacauucgaagcaacuggaaaucuagugguaccgagauaugcauucgcaauggaaagaaaagcuggaucugguauuaucauuucagauacaccaguccacgauugcaauacaacuugucagacacccaagggugcuauaaacaccagccucccauuucagaauauacauucgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguaaucucccugggggcaaucaguuucuggaugugcucuacugggucucuacaguguagaauauguauuuaa

SEQ ID NO: 36999 - RNA, 1701 nt, Artificial Sequence; identical to SEQ ID NO: 33206
  hemagglutinin__InfluenzaA__ADX96747

SEQ ID NO: 37000 - RNA, 1701 nt, Artificial Sequence
  hemagglutinin__InfluenzaA__ADX96757
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucaggcaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaacucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagugccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaacauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauugggaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuacugggucucuacaguguagaauauguauuuaa

SEQ ID NO: 37001 - RNA, 1701 nt, Artificial Sequence
  hemagglutinin__InfluenzaA__ADX96767
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucaguaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagucgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaaauuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuacugggucucuacaguguagaauauguauuuaa

SEQ ID NO: 37002 - RNA, 1701 nt, Artificial Sequence
  hemagglutinin__InfluenzaA__ADX96777
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagugccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauucgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37003 - RNA, 1701 nt, Artificial Sequence
  hemagglutinin__InfluenzaA__ADX96787
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacggaaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacagugcagaauauguauuuaa

SEQ ID NO: 37004 - RNA, 1701 nt, Artificial Sequence
  hemagglutinin__InfluenzaA__ADX96797
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaauuacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguaugguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucagcuucuggaugugcuccaaugggucuuugcaguguagaauaugcauuuaa

SEQ ID NO: 37005 - RNA, 1701 nt, Artificial Sequence
  hemagglutinin__InfluenzaA__ADX96807
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuugugggaucaucaagauucagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaguuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37006 - RNA, 1701 nt, Artificial Sequence; identical to SEQ ID NO: 33197
  hemagglutinin__InfluenzaA__ADX96817

SEQ ID NO: 37007 - RNA, 1701 nt, Artificial Sequence
  hemagglutinin__InfluenzaA__ADX96837
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccuuaugcuggagcaaaaagcuucuacaaaaauuuaauuuggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauuagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccaugauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaguuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuacugggucucuacaguguagaauauguauuuaa

SEQ ID NO: 37008 - RNA, 1701 nt, Artificial Sequence; identical to SEQ ID NO: 33173
  hemagglutinin__InfluenzaA__ADX96847

SEQ ID NO: 37009 - RNA, 1701 nt, Artificial Sequence; identical to SEQ ID NO: 33173
  hemagglutinin__InfluenzaA__ADX96857

SEQ ID NO: 37010 - RNA, 1701 nt, Artificial Sequence
  hemagglutinin__InfluenzaA__ADX96867
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucuuugcaguguagaauaugcauuuaa

SEQ ID NO: 37011 - RNA, 1701 nt, Artificial Sequence
  hemagglutinin__InfluenzaA__ADX96877
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccuagugcuauggggcauucaccauccaucuacuagugcugaccaacaaagucucuaucagaaugcagaugcauauguuuuuguggggacaucaagauacagcaagaaguucaagccggaaauaguaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucagaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucuuuacaguguagaauauguauuuaa

SEQ ID NO: 37012 - RNA, 1701 nt, Artificial Sequence
  hemagglutinin__InfluenzaA__ADX96897
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucaaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaauccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37013 - RNA, 1701 nt, Artificial Sequence
  hemagglutinin__InfluenzaA__ADX96907
augaaggcaauacuaguaguucugcuauauacauuugcaaccgcaaaugcagacacauuauguauagguuaucaugcgaacaauucaacagacacuguagacacaguacuagaaaagaauguaacaguaacacauucuguuaaccuucuagaagacaagcauagcgggaaacuaugcaaacuaagagggguagccccauugcauuuggguaaauguaacauugcuggcuggauucugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgagcaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguggucucccugggggcaaucaguuucuggaugugcucuaaugggucucuacaguguagaauauguauuuaa

SEQ ID NO: 37014 - RNA, 1701 nt, Artificial Sequence
  hemagglutinin__InfluenzaA__ADX96927
augaaggcaauacuaguaguucugcuauauacauuugcaaccgcaaaugcagacacauuauguauagguuaucaugcgaacaauucaacagacacuguagacacauuacuagaaaagaauguaacaguaacacacucuguuaaccuucuagaagacaagcauaacgggaagcuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggacagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaauucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggagagugucaaaaaugggacuuaugauuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37015 - RNA, 1701 nt, Artificial Sequence; identical to SEQ ID NO: 35786
  hemagglutinin__InfluenzaA__ADX96937

SEQ ID NO: 37016 - RNA, 1701 nt, Artificial Sequence; identical to SEQ ID NO: 33197
  hemagglutinin__InfluenzaA__ADX96947

SEQ ID NO: 37017 - RNA, 1701 nt, Artificial Sequence
  hemagglutinin__InfluenzaA__ADX96957
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucaaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37018 - RNA, 1701 nt, Artificial Sequence
  hemagglutinin__InfluenzaA__ADX96967
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuugugggaucaucaagauacagcaagaaguucaagccggaaauagcaauaagacccaaagugagggaucaggaagggagaaugaacuacuacuggacacuaguagagccgggagacaaaauaacauucgaagcaacuggaaaucuagugguaccgagauaugcauucgcaauggaaagaaaugcuggaucugguauuaucauuucagauacaccaguccaugauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaguuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37019 - RNA, 1701 nt, Artificial Sequence
  hemagglutinin__InfluenzaA__ADX96977
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37020 - RNA, 1701 nt, Artificial Sequence
  hemagglutinin__InfluenzaA__ADX96987
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggauaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37021 - RNA, 1701 nt, Artificial Sequence; identical to SEQ ID NO: 33390
  hemagglutinin__InfluenzaA__ADX96997

SEQ ID NO: 37022 - RNA, 1701 nt, Artificial Sequence
  hemagglutinin__InfluenzaA__ADX97007
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagaugcaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37023 - RNA, 1701 nt, Artificial Sequence
  hemagglutinin__InfluenzaA__ADX97018
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaauccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37024 - RNA, 1701 nt, Artificial Sequence
  hemagglutinin__InfluenzaA__ADX97028
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauuuggcuaguuaaacaaggaaauucauacccaaagcucagcaaauccuacauuaaugauaaagggaaagaaguccucgugcuauggggcauucaccauccaucuacuacugcugaccaacaaagucucuaucagaaugcagaugcauauguuuuuguggggucaucaagauacagcaagaaguucaagccggaaauagcaauuagacccaaagugagggaucaagaagggagaaugaacuauuacuggacacuaguagagccgggagacaaaauaacauucgaagcaacuggaaaucuagugguaccaagauaugcauucgcaauggaaagaaaugcuggaucugguauuaucauuucagauacaccaguccaugauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaguuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuucuggaugugcucuaaugggucucuacaguguagaauauguauuuaa

SEQ ID NO: 37025 - RNA, 1701 nt, Artificial Sequence; identical to SEQ ID NO: 35726
  hemagglutinin__InfluenzaA__ADX98640

SEQ ID NO: 37026 - RNA, 1701 nt, Artificial Sequence; identical to SEQ ID NO: 34725
  hemagglutinin__InfluenzaA__ADX98650

SEQ ID NO: 37027 - RNA, 1701 nt, Artificial Sequence
  hemagglutinin__InfluenzaA__ADX98665
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucaggcaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaauacgugcauggaaagugucaaaaaugggacuuaugacuacccaaaauauucagaggaagcaaaauuaaacagagaagaaauagaugggguaaagcuggaaucaacaaggauuuaccagauuuuggcgaucuauucaacugccgccaguucauugguacugguagucucccugggggcaaucaguuucuggaugugcucuaauggaucucuacaguguagaauauguauuuaa

SEQ ID NO: 37028 - RNA, 1701 nt, Artificial Sequence
  hemagglutinin__InfluenzaA__ADX98675
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcagggaucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37029 - RNA, 1701 nt, Artificial Sequence; identical to SEQ ID NO: 34337
  hemagglutinin__InfluenzaA__ADX98695

SEQ ID NO: 37030 - RNA, 1701 nt, Artificial Sequence
  hemagglutinin__InfluenzaA__ADX98729
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaacuaugaggagcuaagagagcaauugagcucagugucaucauuugaaagguuugagauauuccccaagacaaguucauggcccaaucaugacucgaacaaagguguaacggcugcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggagagaaaugcuggaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37031 - RNA, 1701 nt, Artificial Sequence; identical to SEQ ID NO: 36056
  hemagglutinin__InfluenzaA__ADX98739

SEQ ID NO: 37032 - RNA, 1701 nt, Artificial Sequence; identical to SEQ ID NO: 35805
  hemagglutinin__InfluenzaA__ADX98748

SEQ ID NO: 37033 - RNA, 1701 nt, Artificial Sequence; identical to SEQ ID NO: 33173
  hemagglutinin__InfluenzaA__ADX98758

SEQ ID NO: 37034 - RNA, 1701 nt, Artificial Sequence; identical to SEQ ID NO: 35735
  hemagglutinin__InfluenzaA__ADX98767

SEQ ID NO: 37035 - RNA, 1701 nt, Artificial Sequence
  hemagglutinin__InfluenzaA__ADX98777
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacugggaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggguucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuauaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuaccccaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37036 - RNA, 1701 nt, Artificial Sequence
  hemagglutinin__InfluenzaA__ADX98785
augaaggcaauacuaguaguucugcuauauacacuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggauagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauaggugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37037 - RNA, 1701 nt, Artificial Sequence
  hemagglutinin__InfluenzaA__ADX98792
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaaugcaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccuagugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaacucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37038 - RNA, 1701 nt, Artificial Sequence; identical to SEQ ID NO: 34819
  hemagglutinin__InfluenzaA__ADX98806

SEQ ID NO: 37039 - RNA, 1701 nt, Artificial Sequence; identical to SEQ ID NO: 36214
  hemagglutinin__InfluenzaA__ADX98818

SEQ ID NO: 37040 - RNA, 1701 nt, Artificial Sequence; identical to SEQ ID NO: 33800
  hemagglutinin__InfluenzaA__ADX98828

SEQ ID NO: 37041 - RNA, 1701 nt, Artificial Sequence
  hemagglutinin__InfluenzaA__ADX98843
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagaguguggaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuaguggugccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgggauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuagaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37042 - RNA, 1701 nt, Artificial Sequence
  hemagglutinin__InfluenzaA__ADX98853
augaaggcaauacuaguaguucugcuauauacauuugcaaccgcaaaugcagacacauuauguauagguuaucaugcgaacaauucaacagacacuguagacacaguauuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccauagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuaucacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggguucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37043 - RNA, 1701 nt, Artificial Sequence; identical to SEQ ID NO: 34714
  hemagglutinin__InfluenzaA__ADX98860

SEQ ID NO: 37044 - RNA, 1701 nt, Artificial Sequence; identical to SEQ ID NO: 35725
  hemagglutinin__InfluenzaA__ADX98870

SEQ ID NO: 37045 - RNA, 1701 nt, Artificial Sequence
  hemagglutinin__InfluenzaA__ADX98880
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaagagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuauuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuauccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37046 - RNA, 1701 nt, Artificial Sequence
  hemagglutinin__InfluenzaA__ADX98890
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcugaaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaacgaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37047 - RNA, 1701 nt, Artificial Sequence
  hemagglutinin__InfluenzaA__ADX98900
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcugcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacuuguagucucccugggggcaaucaguuucuggaugugcucuaaugggucucuacaguguagaauauguauuuaa

SEQ ID NO: 37048 - RNA, 1701 nt, Artificial Sequence
  hemagglutinin__InfluenzaA__ADX98910
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaucucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37049 - RNA, 1701 nt, Artificial Sequence
  hemagglutinin__InfluenzaA__ADX98920
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagaggaguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagccaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37050 - RNA, 1701 nt, Artificial Sequence; identical to SEQ ID NO: 34735
  hemagglutinin__InfluenzaA__ADX98930

SEQ ID NO: 37051 - RNA, 1701 nt, Artificial Sequence
  hemagglutinin__InfluenzaA__ADX98940
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacauguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucguacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagggccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37052 - RNA, 1701 nt, Artificial Sequence; identical to SEQ ID NO: 35793
  hemagglutinin__InfluenzaA__ADX98950

SEQ ID NO: 37053 - RNA, 1701 nt, Artificial Sequence; identical to SEQ ID NO: 35774
  hemagglutinin__InfluenzaA__ADX98960

SEQ ID NO: 37054 - RNA, 1701 nt, Artificial Sequence
  hemagglutinin__InfluenzaA__ADX98970
augaaggcaauacuaguaguucugcuauauacguuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaggucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaucaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauacgaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37055 - RNA, 1701 nt, Artificial Sequence; identical to SEQ ID NO: 34459
  hemagglutinin__InfluenzaA__ADX98980

SEQ ID NO: 37056 - RNA, 1701 nt, Artificial Sequence; identical to SEQ ID NO: 33206
  hemagglutinin__InfluenzaA__ADX98990

SEQ ID NO: 37057 - RNA, 1701 nt, Artificial Sequence; identical to SEQ ID NO: 34337
  hemagglutinin__InfluenzaA__ADX99000

SEQ ID NO: 37058 - RNA, 1698 nt, Artificial Sequence
  hemagglutinin__InfluenzaA__ADX99581
augaaggcaaaccuacugguccuguuaagugcacuugcagcugcagaugcagacacaauauguauaggcuaccaugcgaacaauucaaccgacacuguugacacaguacucgagaagaaugugacagugacacacucuguuaaccugcucgaagacagccacaacggaaaacuauguagauuaaaaggaauagccccacuacaauuggggaaauguaacaucgccggauggcucuugggaaacccagaaugcgacccacugcuuccagugagaucaugguccuacauuguagaaacaccaaacucugagaauggaauauguuauccaggagauuucaucgacuaugaggagcugagggagcaauugagcucagugucaucauucgaaagauucgaaauauuucccaaagaaagcucauggcccaaccacaacacaaacggaguaacggcagcaugcucccaugaggggaaaagcaguuuuuacagaaauuugcuauggcugacggagaaggagggcucauacccaaagcugaaaaauucuuaugugaacaaaaaagggaaagaaguccuuguacugugggguauucaucacccgccuaacaguaaggaacaacagaaucucuaucagaaugaaaaugcuuaugucucuguagugacuucaaauuauaacaggagauuuaccccggaaauagcagaaagacccaaaguaagagaucaagcugggaggaugaacuauuacuggaccuugcuaaaacccggagacacaauaauauuugaggcaaauggaaaucuaauagcaccaauguaugcuuucgcacugaguagaggcuuuggguccggcaucaucaccucaaacgcaucaaugcaugaguguaacacgaagugucaaacaccccugggagcuauaaacagcagucucccuuaccagaauauacacccagucacaauaggagagugcccaaaauacgucaggagugccaaauugaggaugguuacaggacuaaggaacacuccguccauucaauccagaggucuauuuggagccauugccgguuuuauugaagggggauggacuggaaugauagauggaugguaugguuaucaucaucagaaugaacagggaucaggcuaugcagcggaucaaaaaagcacacaaaaugccauuaacgggauuacaaacaaggugaacacuguuaucgagaaaaugaacauucaauucacagcuguggguaaagaauucaacaaauuagaaaaaaggauggaaaauuuaaauaaaaaaguugaugauggauuucuggacauuuggacauauaaugcagaauuguuaguucuacuggaaaaugaaaggacucuggauuuccaugacucaaaugugaagaaucuguaugagaaaguaaaaagccaauuaaagaauaaugccaaagaaaucggaaauggauguuuugaguucuaccacaagugugacaaugaaugcauggaaaguguaagaaaugggacuuaugauuaucccaaauauucagaagagucaaaguugaacagggaaaagguagauggagugaaauuggaaucaauggggaucuaucagauucuggcgaucuacucaacugucgccaguucacuggugcuuuuggucucccugggggcaaucaguuucuggauguguucuaauggaucuuugcagugcagaauaugcaucuga

SEQ ID NO: 37059 - RNA, 1698 nt, Artificial Sequence; identical to SEQ ID NO: 37058
  hemagglutinin__InfluenzaA__ADX99592

SEQ ID NO: 37060 - RNA, 1698 nt, Artificial Sequence; identical to SEQ ID NO: 37058
  hemagglutinin__InfluenzaA__ADX99603

SEQ ID NO: 37061 - RNA, 1698 nt, Artificial Sequence
  hemagglutinin__InfluenzaA__ADX99614
augaaggcaaaccuacugguccuguuaagugcacuugcagcugcagaugcagacacaauauguauaggcuaccaugcgaacaauucaaccgacacuguugacacaguacucgagaagaaugugacagugacacacucuguuaaccugcucgaagacagccacaacggaaaacuauguagauuaaaaggaauagccccacuacaauuggggaaauguaacaucgccggauggcucuugggaaacccagaaugcgacccacugcuuccagugagaucaugguccuacauuguagaaacaccaaacucugagaauggaauauguuauccaggagauuucaucgacuaugaggagcugagggagcaauugagcucagugucaucauucgaaagauucgaaauauuucccaaagaaagcucauggcccaaccacaacacaaacggaguaacggcagcaugcucccaugaggggaaaagcaguuuuuacagaaauuugcuauggcugacggagaagaagggcucauacccaaagcugaaaaauucuuaugugaacaaaaaagggaaagaaguccuuguacugugggguauucaucacccgccuaacaguaaggaacaacagaaucucuaucagaaugaaaaugcuuaugucucuguagugacuucaaauuauaacaggagauuuaccccggaaauagcagaaagacccaaaguaagagaucaagcugggaggaugaacuauuacuggaccuugcuaaaacccggagacacaauaauauuugaggcaaauggaaaucuaauagcaccaauguaugcuuucgcacugaguagaggcuuuggguccggcaucaucaccucaaacgcaucaaugcaugaguguaacacgaagugucaaacaccccugggagcuauaaacagcagucucccuuaccagaauauacacccagucacaauaggagagugcccaaaauacgucaggagugccaaauugaggaugguuacaggacuaaggaacacuccguccauucaauccagaggucuauuuggagccauugccgguuuuauugaagggggauggacuggaaugauagauggaugguaugguuaucaucaucagaaugaacagggaucaggcuaugcagcggaucaaaaaagcacacaaaaugccauuaacgggauuacaaacaaggugaacacuguuaucgagaaaaugaacauucaauucacagcuguggguaaagaauucaacaaauuagaaaaaaggauggaaaauuuaaauaaaaaaguugaugauggauuucuggacauuuggacauauaaugcagaauuguuaguucuacuggaaaaugaaaggacucuggauuuccaugacucaaaugugaagaaucuguaugagaaaguaaaaagccaauuaaagaauaaugccaaagaaaucggaaauggauguuuugaguucuaccacaagugugacaaugaaugcauggaaaguguaagaaaugggacuuaugauuaucccaaauauucagaagagucaaaguugaacagggaaaagguagauggagugaaauuggaaucaauggggaucuaucagauucuggcgaucuacucaacugucgccaguucacuggugcuuuuggucucccugggggcaaucaguuucuggauguguucuaauggaucuuugcagugcagaauaugcaucuga

SEQ ID NO: 37062 - RNA, 1698 nt, Artificial Sequence
  hemagglutinin__InfluenzaA__ADX99625
augaaggcaaaccuacugguccuguuaagugcacuugcagcugcagaugcagacacaauauguauaggcuaccaugcgaacaauucaaccgacacuguugacacaguacucgagaagaaugugacagugacacacucuguuaaccugcucgaagacagccacaacggaaaacuauguagauuaaaaggaauagccccacuacaauuggggaaauguaacaucgccggauggcucuugggaaacccagaaugcgacccacugcuuccagugagaucaugguccuacauuguagaaacaccaaacucugagaauggaauauguuauccaggagauuucaucgacuaugaggagcugagggagcaauugagcucagugucaucauucgaaagauucgaaauauuucccaaagaaagcucauggcccaaccacaacacaaacggaguaacggcagcaugcucccaugaggggaaaagcaguuuuuacagaaauuugcuauggcugacggagaaggagggcucauacccaaagcugaaaaauucuuaugugaacaaaaaagggaaagaaguccuuguacugugggguauucaucacccgccuaacaguaaggaacaacagaaucucuaucagaaugaaaaugcuuaugucucuguagugacuucaaauuauaacaggagauuuaccccggaaauagcagaaagacccaaaguaagagaucaagcugggaggaugaacuauuacuggaccuugcuaaaacccggagacacaauaauauuuggggcaaauggaaaucuaauagcaccaauguaugcuuucgcacugaguagaggcuuuggguccggcaucaucaccucaaacgcaucaaugcaugaguguaacacgaagugucaaacaccccugggagcuauaaacagcagucucccuuaccagaauauacacccagucacaauaggagagugcccaaaauacgucaggagugccaaauugaggaugguuacaggacuaaggaacacuccguccauucaauccagaggucuauuuggagccauugccgguuuuauugaagggggauggacuggaaugauagauggaugguaugguuaucaucaucagaaugaacagggaucaggcuaugcagcggaucaaaaaagcacacaaaaugccauuaacgggauuacaaacaaggugaacacuguuaucgagaaaaugaacauucaauucacagcuguggguaaagaauucaacaaauuagaaaaaaggauggaaaauuuaaauaaaaaaguugaugauggauuucuggacauuuggacauauaaugcagaauuguuaguucuacuggaaaaugaaaggacucuggauuuccaugacucaaaugugaagaaucuguaugagaaaguaaaaagccaauuaaagaauaaugccaaagaaaucggaaauggauguuuugaguucuaccacaagugugacaaugaaugcauggaaaguguaagaaaugggacuuaugauuaucccaaauauucagaagagucaaaguugaacagggaaaagguagauggagugaaauuggaaucaauggggaucuaucagauucuggcgaucuacucaacugucgccaguucacuggugcuuuuggucucccugggggcaaucaguuucuggauguguucuaauggaucuuugcagugcagaauaugcaucuga

SEQ ID NO: 37063 - RNA, 1698 nt, Artificial Sequence
  hemagglutinin__InfluenzaA__ADX99636
augaaggcaaaccuacugguccuguuaagugcacuugcagcugcagaugcagacacaauauguauaggcuaccaugcgaacaauucaaccgacacuguugacacaguacucgagaagaaugugacagugacacacucuguuaaccugcucgaagacagccacaacggaaaacuauguagauuaaaaggaauagccccacuacaauuggggaaauguaacaucgccggauggcucuugggaaacccagaaugcgacccacugcuuccagugagaucaugguccuacauuguagaaacaccaaacucugagaauggaauauguuauccaggagauuucaucgacuaugaggagcugagggagcaauugagcucagugucaucauucgaaagauucgaaauauuucccaaagaaagcucauggcccaaccacaacacaaacggaguaacggcagcaugcucccaugaggggaaaagcaguuuuuacagaaauuugcuauggcugacgaagaaggagggcucauacccaaagcugaaaaauucuuaugugaacaaaaaagggaaagaaguccuuguacugugggguauucaucacccgccuaacaguaaggaacaacagaaucucuaucagaaugaaaaugcuuaugucucuguagugacuucaaauuauaacaggagauuuaccccggaaauagcagaaagacccaaaguaagagaucaagcugggaggaugaacuauuacuggaccuugcuaaaacccggagacacaauaauauuugaggcaaauggaaaucuaauagcaccaauguaugcuuucgcacugaguagaggcuuuggguccggcaucaucaccucaaacgcaucaaugcaugaguguaacacgaagugucaaacaccccugggagcuauaaacagcagucucccuuaccagaauauacacccagucacaauaggagagugcccaaaauacgucaggagugccaaauugaggaugguuacaggacuaaggaacacuccguccauucaauccagaggucuauuuggagccauugccgguuuuauugaagggggauggacuggaaugauagauggaugguaugguuaucaucaucagaaugaacagggaucaggcuaugcagcggaucaaaaaagcacacaaaaugccauuaacgggauuacaaacaaggugaacacuguuaucgagaaaaugaacauucaauucacagcuguggguaaagaauucaacaaauuagaaaaaaggauggaaaauuuaaauaaaaaaguugaugauggauuucuggacauuuggacauauaaugcagaauuguuaguucuacuggaaaaugaaaggacucuggauuuccaugacucaaaugugaagaaucuguaugagaaaguaaaaagccaauuaaagaauaaugccaaagaaaucggaaauggauguuuugaguucuaccacaagugugacaaugaaugcauggaaaguguaagaaaugggacuuaugauuaucccaaauauucagaagagucaaaguugaacagggaaaagguagauggagugaaauuggaaucaauggggaucuaucagauucuggcgaucuacucaacugucgccaguucacuggugcuuuuggucucccugggggcaaucaguuucuggauguguucuaauggaucuuugcagugcagaauaugcaucuga

SEQ ID NO: 37064 - RNA, 1698 nt, Artificial Sequence; identical to SEQ ID NO: 33782
  hemagglutinin__InfluenzaA__ADX99647

SEQ ID NO: 37065 - RNA, 1698 nt, Artificial Sequence
  hemagglutinin__InfluenzaA__ADX99680
augaaggcaaaccuacugguccuguuaugugcacuugcagcugcagaugcagacacaauauguauaggcuaccaugcgaacaauucaaccgacacuguugacacaguacucgagaagaaugugacagugacacacucuguuaaccugcucgaagacagccacaacggaaaacuauguagauuaaaaggaauagccccacuacaauuggggaaauguaacaucgccggauggcucuugggaaacccagaaugcgacccacugcuuccagugagaucaugguccuacauuguagaaacaccaaacucugagaauggaauauguuauccaggagauuucaucgacuaugaggagcugagggagcaauugagcucagugucaucauucgaaagauucgaaauauuucccaaagaaagcucaugguccaaccacaacacaaacggaguaacggcagcaugcucccaugaggggaaaagcaguuuuuacagaaauuugcuauggcugacggagaaggagggcucauacccaaagcugaaaaauucuuaugugaacaaaaaagggaaagaaguccuuguacugugggguauucaucacccgccuaacaguaaggaacaacagaaucucuaucagaaugaaaaugcuuaugucucuguagugacuucaaauuauaacaggagauuuaccccggaaauagcagaaagacccaaaguaagagaucaagcugggaggaugaacuauuacuggaccuugcuaaaacccggagacacaauaauauuugaggcaaauggaaaucuaauagcaccaauguaugcuuucgcacugaguagaggcuuuggguccggcaucaucaccucaaacgcaucaaugcaugaguguaacacgaagugucaaacaccccugggagcuauaaacagcagucucccuuaccagaauauacacccagucacaauaggagagugcccaaaauacgucaggagugccaaauugaggaugguuacaggacuaaggaacauuccguccauucaauccagaggucuauuuggagccauugccgguuuuauugaagggggauggacuggaaugauagauggaugguaugguuaucaucaucagaaugaacagggaucaggcuaugcagcggaucaaaaaagcacacaaaaugccauuaacgggauuacaaacaaggugaacacuguuaucgagaaaaugaacauucaauucacagcuguggguaaagaauucaacaaauuagaaaaaaggauggaaaauuuaaauaaaaaaguugaugauggauuucuggacauuuggacauauaaugcagaauuguuaguucuacuggaaaaugaaaggacucuggauuuccaugacucaaaugugaagaaucuguaugagaaaguaaaaagccaauuaaagaauaaugccaaagaaaucggaaauggauguuuugaguucuaccacaagugugacaaugaaugcauggaaaguguaagaaaugggacuuaugauuaucccaaauauucagaagagucaaaguugaacagggaaaagguagauggagugaaauuggaaucaauggggaucuaucagauucuggcgaucuacucaacugucgccaguucacuggugcuuuuggucucccugggggcaaucaguuucuggauguguucuaauggaucuuugcagugcagaauaugcaucuga

SEQ ID NO: 37066 - RNA, 1698 nt, Artificial Sequence
  hemagglutinin__InfluenzaA__ADX99702
augaaggcaaaccuacugguccuguuaugugcacuugcagcugcagaugcagacacaauauguauaggcuaccaugcgaacaauucaaccgacacuguugacacaguacucgagaagaaugugacagugacacacucuguuaaccugcucgaagacagccacaacggaaaacuauguagauuaaaaggaauagccccacuacaauuggggaaauguaacaucgccggauggcucuugggaaacccagaaugcgacccacugcuuccagugagaucaugguccuacauuguagaaacaccaaacucugagaauggaauauguuauccaggagauuucaucgacuaugaggagcugagggagcaauugagcucagugucaucauucgaaagauucgaaauauuucccaaagaaagcucauggcccaaccacaacacaaacggaguaacggcagcaugcucccaugaggggaaaagcaguuuuuacagaaauuugcuauggcugacggagaaggagggcucauacccaaagcugaaaaaaucuuaugugaacaaaaaagggaaagaaguccuuguacugugggguauucaucacccgccuaacaguaaggaacaacagaaucucuaucagaaugaaaaugcuuaugucucuguagugacuucaaauuauaacaggagauuuaccccggaaauagcagaaagacccaaaguaagagaucaagcugggaggaugaacuauuacuggaccuugcuaaaacccggagacacaauaauauuugaggcaaauggaaaucuaauagcaccaauguaugcuuucgcacugaguagaggcuuuggguccggcaucaucaccucaaacgcaucaaugcaugaguguaacacgaagugucaaacaccccugggagcuauaaacagcagucucccuuaccagaauauacacccagucacaauaggagagugcccaaaauacgucaggagugccaaauugaggaugguuacaggacuaaggaacauuccguccauucaauccagaggucuauuuggagccauugccgguuuuauugaagggggauggacuggaaugauagauggaugguaugguuaucaucaucagaaugaacagggaucaggcuaugcagcggaucaaaaaagcacacaaaaugccauuaacgggauuacaaacaaggugaacacuguuaucgagaaaaugaacauucaauucacagcuguggguaaagaauucaacaaauuagaaaaaaggauggaaaauuuaaauaaaaaaguugaugauggauuucuggacauuuggacauauaaugcagaauuguuaguucuacuggaaaaugaaaggacucuggauuuccaugacucaaaugugaagaaucuguaugagaaaguaaaaagccaauuaaagaauaaugccaaagaaaucggaaauggauguuuugaguucuaccacaagugugacaaugaaugcauggaaaguguaagaaaugggacuuaugauuaucccaaauauucagaagagucaaaguugaacagggaaaagguagauggagugaaauuggaaucaauggggaucuaucagauucuggcgaucuacucaacugucgccaguucacuggugcuuuuggucucccugggggcaaucaguuucuggauguguucuaauggaucuuugcagugcagaauaugcaucuga

SEQ ID NO: 37067 - RNA, 1698 nt, Artificial Sequence
  hemagglutinin__InfluenzaA__ADX99843
augaaggcaaaccuacugguccuguuaugugcacuugcagcugcagaugcagacacaauauguauaggcuaccaugcgaacaauucaaccgacacuguugacacaguacucgagaagaaugugacagugacacacucuguuaaccugcucgaagacagccacaacggaaaacuauguagauuaaaaggaauagccccacuacaauuggggaaauguaacaucgccggauggcucuugggaaacccagaaugcgacccacugcuuccagugagaucaugguccuacauuguagaaacaccaaacucugagaauggaauauguuauccaggagauuucaucgacuaugaggagcugagggagcaauugagcucagugucaucauucgaaagauucgaaauauuucccaaagaaagcucauggcccaaccacaacacaaacggaguaacggcagcaugcucccaugaggggaaaagcaguuuuuacagaaauuugcuauggcugacggagaaggagggcucauacccaaagcugaaaaagucuuaugugaacaaaaaagggaaagaaguccuuguacugugggguauucaucacccgccuaacaguaaggaacaacagaaucucuaucagaaugaaaaugcuuaugucucuguagugacuucaaauuauaacaggagauuuaccccggaaauagcagaaagacccaaaguaagagaucaagcugggaggaugaacuauuacuggaccuugcuaaaacccggagacacaauaauauuugaggcaaauggaaaucuaauagcaccaauguaugcuuucgcacugaguagaggcuuuggguccggcaucaucaccucaaacgcaucaaugcaugaguguaacacgaagugucaaacaccccugggagcuauaaacagcagucucccuuaccagaauauacacccagucacaauaggagagugcccaaaauacgucaggagugccaaauugaggaugguuacaggacuaaggaacauuccguccauucaauccagaggucuauuuggagccauugccgguuuuauugaagggggauggacuggaaugauagauggaugguaugguuaucaucaucagaaugaacagggaucaggcuaugcagcggaucaaaaaagcacacaaaaugccauuaacgggauuacaaacaaggugaacacuguuaucgagaaaaugaacauucaauucacagcuguggguaaagaauucaacaaauuagaaaaaaggauggaaaauuuaaauaaaaaaguugaugauggauuucuggacauuuggacauauaaugcagaauuguuaguucuacuggaaaaugaaaggacucuggauuuccaugacucaaaugugaagaaucuguaugagaaaguaaaaagccaauuaaagaauaaugccaaagaaaucggaaauggauguuuugaguucuaccacaagugugacaaugaaugcauggaaaguguaagaaaugggacuuaugauuaucccaaauauucagaagagucaaaguugaacagggaaaagguagauggagugaaauuggaaucaauggggaucuaucagauucuggcgaucuacucaacugucgccaguucacuggugcuuuuggucucccugggggcaaucaguuucuggauguguucuaauggaucuuugcagugcagaauaugcaucuga

SEQ ID NO: 37068 - RNA, 1698 nt, Artificial Sequence
  hemagglutinin__InfluenzaA__ADX99854
augaaggcaaaccuacugguccuguuaugugcacuugcagcugcagaugcagacacaauauguauaggcuaccaugcgaacaauucaaccgacacuguugacacaguacucgagaagaaugugacagugacacacucuguuaaccugcucgaagacagccacaacggaaaacuauguagauuaaaaggaauagccccacuacaauuggggaaauguaacaucgccggauggcucuugggaaacccagaaugcgacccacugcuuccagugagaucaugguccuacauuguagaaacaccaaacucugagaauggaauauguuauccaggagauuucaucgacuaugaggagcugagggagcaauugagcucagugucaucauucgaaagauucgaaauauuucccaaagaaagcucauggcccaaccacaacacaaacggaguaacggcagcaugcucccaugaggggaaaagcaguuuuuacagaaauuugcuauggcugacggagaaggagggcucauaccuaaagcugaaaaauucuuaugugaacaaaaaagggaaagaaguccuuguacugugggguauucaucacccgccuaacaguaaggaacaacagaaucucuaucagaaugaaaaugcuuaugucucuguagugacuucaaauuauaacaggagauuuaccccggaaauagcagaaagacccaaaguaagagaucaagcugggaggaugaacuauuacuggaccuugcuaaaacccggagacacaauaauauuugaggcaaauggaaaucuaauagcaccaauguaugcuuucgcacugaguagaggcuuuggguccggcaucaucaccucaaacgcaucaaugcaugaguguaacacgaagugucaaacaccccugggagcuauaaacagcagucucccuuaccagaauauacacccagucacaauaggagagugcccaaaauacgucaggagugccaaauugaggaugguuacaggacuaaggaacauuccguccauucaauccagaggucuauuuggagccauugccgguuuuauugaagggggauggacuggaaugauagauggaugguaugguuaucaucaucagaaugaacagggaucaggcuaugcagcggaucaaaaaagcacacaaaaugccauuaacgggauuacaaacaaggugaacacuguuaucgagaaaaugaacauucaauucacagcuguggguaaagaauucaacaaauuagaaaaaaggauggaaaauuuaaauaaaaaaguugaugauggauuucuggacauuuggacauauaaugcagaauuguuaguucuacuggaaaaugaaaggacucuggauuuccaugacucaaaugugaagaaucuguaugagaaaguaaaaagccaauuaaagaauaaugccaaagaaaucggaaauggauguuuugaguucuaccacaagugugacaaugaaugcauggaaaguguaagaaaugggacuuaugauuaucccaaauauucagaagagucaaaguugaacagggaaaagguagauggagugaaauuggaaucaauggggaucuaucagauucuggcgaucuacucaacugucgccaguucacuggugcuuuuggucucccugggggcaaucaguuucuggauguguucuaauggaucuuugcagugcagaauaugcaucuga

SEQ ID NO: 37069 - RNA, 1698 nt, Artificial Sequence
  hemagglutinin__InfluenzaA__ADX99865
augaaggcaaaccuacugguccuguuaugugcacuugcagcugcagaugcagacacaauauguauaggcuaccaugcgaacaauucaaccgacacuguugacacaguacucgagaagaaugugacagugacacacucuguuaaccugcucgaagacagccacaacggaaaacuauguagauuaaaaggaauagccccacuacaauuggggaaauguaacaucgccggauggcucuugggaaacccagaaugcgacccacugcuuccagugagaucaugguccuacauuguagaaacaccaaacucugagaauggaauauguuauccaggagauuucaucgacuaugaggagcugagggagcaauugagcucagugucaucauucgaaagauucgaaauauuucccaaagaaagcucauggcccaaccacaacacaaacggaguaacggcagcaugcucccaugaggggaaaagcaguuuuuacagaaauuugcuauggcugacggagaaggagggcucauacccaaagcagaaaaauucuuaugugaacaaaaaagggaaagaaguccuuguacugugggguauucaucacccgccuaacaguaaggaacaacagaaucucuaucagaaugaaaaugcuuaugucucuguagugacuucaaauuauaacaggagauuuaccccggaaauagcagaaagacccaaaguaagagaucaagcugggaggaugaacuauuacuggaccuugcuaaaacccggagacacaauaauauuugaggcaaauggaaaucuaauagcaccaauguaugcuuucgcacugaguagaggcuuuggguccggcaucaucaccucaaacgcaucaaugcaugaguguaacacgaagugucaaacaccccugggagcuauaaacagcagucucccuuaccagaauauacacccagucacaauaggagagugcccaaaauacgucaggagugccaaauugaggaugguuacaggacuaaggaacauuccguccauucaauccagaggucuauuuggagccauugccgguuuuauugaagggggauggacuggaaugauagauggaugguaugguuaucaucaucagaaugaacagggaucaggcuaugcagcggaucaaaaaagcacacaaaaugccauuaacgggauuacaaacaaggugaacacuguuaucgagaaaaugaacauucaauucacagcuguggguaaagaauucaacaaauuagaaaaaaggauggaaaauuuaaauaaaaaaguugaugauggauuucuggacauuuggacauauaaugcagaauuguuaguucuacuggaaaaugaaaggacucuggauuuccaugacucaaaugugaagaaucuguaugagaaaguaaaaagccaauuaaagaauaaugccaaagaaaucggaaauggauguuuugaguucuaccacaagugugacaaugaaugcauggaaaguguaagaaaugggacuuaugauuaucccaaauauucagaagagucaaaguugaacagggaaaagguagauggagugaaauuggaaucaauggggaucuaucagauucuggcgaucuacucaacugucgccaguucacuggugcuuuuggucucccugggggcaaucaguuucuggauguguucuaauggaucuuugcagugcagaauaugcaucuga

SEQ ID NO: 37070 - RNA, 1698 nt, Artificial Sequence
  hemagglutinin__InfluenzaA__ADX99887
augaaggcaaaccuacugguccuguuaugugcacuugcagcugcagaugcagacacaauauguauaggcuaccaugcgaacaauucaaccgacacuguugacacaguacucgagaagaaugugacagugacacacucuguuaaccugcucgaagacagccacaacggaaaacuauguagauuaaaaggaauagccccacuacaauuggggaaauguaacaucgccggauggcucuugggaaacccagaaugcgacccacugcuuccagugagaucaugguccuacauuguagaaacaccaaacucugagaauggaauauguuauccaggagauuucaucgacuaugaggagcugagggagcaauugagcucagugucaucauucgaaagauucgaaauauuucccaaagaaagcucauggcccaaccacaacacaaacggaguaacggcagcaugcucccaugaggggaaaagcaguuuuuacagaaauuugcuauggcugacggagaaggagggcucauacccaaagcuggaaaauucuuaugugaacaaaaaagggaaagaaguccuuguacugugggguauucaucacccgccuaacaguaaggaacaacagaaucucuaucagaaugaaaaugcuuaugucucuguagugacuucaaauuauaacaggagauuuaccccggaaauagcagaaagauccaaaguaagagaucaagcugggaggaugaacuauuacuggaccuugcuaaaacccggagacacaauaauauuugaggcaaauggaaaucuaauagcaccaauguaugcuuucgcacugaguagaggcuuuggguccggcaucaucaccucaaacgcaucaaugcaugaguguaacacgaagugucaaacaccccugggagcuauaaacagcagucucccuuaccagaauauacacccagucacaauaggagagugcccaaaauacgucaggagugccaaauugaggaugguuacaggacuaaggaacauuccguccauucaauccagaggucuauuuggagccauugccgguuuuauugaagggggauggacuggaaugauagauggaugguaugguuaucaucaucagaaugaacagggaucaggcuaugcagcggaucaaaaaagcacacaaaaugccauuaacgggauuacaaacaaggugaacacuguuaucgagaaaaugaacauucaauucacagcuguggguaaagaauucaacaaauuagaaaaaaggauggaaaauuuaaauaaaaaaguugaugauggauuucuggacauuuggacauauaaugcagaauuguuaguucuacuggaaaaugaaaggacucuggauuuccaugacucaaaugugaagaaucuguaugagaaaguaaaaagccaauuaaagaauaaugccaaagaaaucggaaauggauguuuugaguucuaccacaagugugacaaugaaugcauggaaaguguaagaaaugggacuuaugauuaucccaaauauucagaagagucaaaguugaacagggaaaagguagauggagugaaauuggaaucaauggggaucuaucagauucuggcgaucuacucaacugucgccaguucacuggugcuuuuggucucccugggggcaaucaguuucuggauguguucuaauggaucuuugcagugcagaauaugcaucuga

SEQ ID NO: 37071 - RNA, 1698 nt, Artificial Sequence
  hemagglutinin__InfluenzaA__ADX99898
augaaggcaaaccuacugguccuguuaugugcacuugcagcugcagaugcagacacaauauguauaggcuaccaugcgaacaauucaaccgacacuguugacacaguacucgagaagaaugugacagugacacacucuguuaaccugcucgaagacagccacaacggaaaacuauguagauuaaaaggaauagccccacuacaauuggggaaauguaacaucgccggauggcucuugggaaacccagaaugcgacccacugcuuccagugagaucaugguccuacauuguagaaacaccaaacucugagaauggaauauguuauccaggagauuucaucgacuaugaggagcugagggagcaauugagcucagugucaucauucgaaagauucgaaauauuucccaaagaaagcucauggcccaaccacaacacaaacggaguaacggcagcaugcucccaugaggggaaaagcaguuuuuacagaaauuugcuauggcugacggagaaggagggcucauacccaaagcugaaaaauuauuaugugaacaaaaaagggaaagaaguccuuguacugugggguauucaucacccgccuaacaguaaggaacaacagaaucucuaucagaaugaaaaugcuuaugucucuguagugacuucaaauuauaacaggagauuuaccccggaaauagcagaaagacccaaaguaagagaucaagcugggaggaugaacuauuacuggaccuugcuaaaacccggagacacaauaauauuugaggcaaauggaaaucuaauagcaccaauguaugcuuucgcacugaguagaggcuuuggguccggcaucaucaccucaaacgcaucaaugcaugaguguaacacgaagugucaaacaccccugggagcuauaaacagcagucucccuuaccagaauauacacccagucacaauaggagagugcccaaaauacgucaggagugccaaauugaggaugguuacaggacuaaggaacauuccguccauucaauccagaggucuauuuggagccauugccgguuuuauugaagggggauggacuggaaugauagauggaugguaugguuaucaucaucagaaugaacagggaucaggcuaugcagcggaucaaaaaagcacacaaaaugccauuaacgggauuacaaacaaggugaacacuguuaucgagaaaaugaacauucaauucacagcuguggguaaagaauucaacaaauuagaaaaaaggauggaaaauuuaaauaaaaaaguugaugauggauuucuggacauuuggacauauaaugcagaauuguuaguucuacuggaaaaugaaaggacucuggauuuccaugacucaaaugugaagaaucuguaugagaaaguaaaaagccaauuaaagaauaaugccaaagaaaucggaaauggauguuuugaguucuaccacaagugugacaaugaaugcauggaaaguguaagaaaugggacuuaugauuaucccaaauauucagaagagucaaaguugaacagggaaaagguagauggagugaaauuggaaucaauggggaucuaucagauucuggcgaucuacucaacugucgccaguucacuggugcuuuuggucucccugggggcaaucaguuucuggauguguucuaauggaucuuugcagugcagaauaugcaucuga

SEQ ID NO: 37072 - RNA, 1698 nt, Artificial Sequence
  hemagglutinin__InfluenzaA__ADX99909
augaaggcaaaccuacugguccuguuaugugcacuugcagcugcagaugcagacacaauauguauaggcuaccaugcgaacaauucaaccgacacuguugacacaguacucgagaagaaugugacagugacacacucuguuaaccugcucgaagacagccacaacggaaaacuauguagauuaaaaggaauagccccacuacaauuggggaaauguaacaucgccggauggcucuugggaaacccagaaugcgacccacugcuuccagugagaucaugguccuacauuguagaaacaccaaacucugagaauggaauauguuauccaggagauuucaucgacuaugaggagcugagggagcaauugagcucagugucaucauucgaaagauucgaaauauuucccaaagaaagcucauggcccaaccacaacacaaacggaguaacggcagcaugcucccaugaggggaaaagcaguuuuuacagaaauuugcuauggcugacggagaaggagggcucauacccaaagcugaaaaauuuuuaugugaacaaaaaagggaaagaaguccuuguacugugggguauucaucacccgccuaacaguaaggaacaacagaaucucuaucagaaugaaaaugcuuaugucucuguagugacuucaaauuauaacaggagauuuaccccggaaauagcagaaagacccaaaguaagagaucaagcugggaggaugaacuauuacuggaccuugcuaaaacccggagacacaauaauauuugaggcaaauggaaaucuaauagcaccaauguaugcuuucgcacugaguagaggcuuuggguccggcaucaucaccucaaacgcaucaaugcaugaguguaacacgaagugucaaacaccccugggagcuauaaacagcagucucccuuaccagaauauacacccagucacaauaggagagugcccaaaauacgucaggagugccaaauugaggaugguuacaggacuaaggaacauuccguccauucaauccagaggucuauuuggagccauugccgguuuuauugaagggggauggacuggaaugauagauggaugguaugguuaucaucaucagaaugaacagggaucaggcuaugcagcggaucaaaaaagcacacaaaaugccauuaacgggauuacaaacaaggugaacacuguuaucgagaaaaugaacauucaauucacagcuguggguaaagaauucaacaaauuagaaaaaaggauggaaaauuuaaauaaaaaaguugaugauggauuucuggacauuuggacauauaaugcagaauuguuaguucuacuggaaaaugaaaggacucuggauuuccaugacucaaaugugaagaaucuguaugagaaaguaaaaagccaauuaaagaauaaugccaaagaaaucggaaauggauguuuugaguucuaccacaagugugacaaugaaugcauggaaaguguaagaaaugggacuuaugauuaucccaaauauucagaagagucaaaguugaacagggaaaagguagauggagugaaauuggaaucaauggggaucuaucagauucuggcgaucuacucaacugucgccaguucacuggugcuuuuggucucccugggggcaaucaguuucuggauguguucuaauggaucuuugcagugcagaauaugcaucuga

SEQ ID NO: 37073 - RNA, 1698 nt, Artificial Sequence; identical to SEQ ID NO: 37072
  hemagglutinin__InfluenzaA__ADX99920

SEQ ID NO: 37074 - RNA, 1698 nt, Artificial Sequence
  hemagglutinin__InfluenzaA__ADX99931
augaaggcaaaccuacugguccuguuaugugcacuugcagcugcagaugcagacacaauauguauaggcuaccaugcgaacaauucaaccgacacuguugacacaguacucgagaagaaugugacagugacacacucuguuaaccugcucgaagacagccacaacggaaaacuauguagauuaaaaggaauagccccacuacaauuggggaaauguaacaucgccggauggcucuugggaaacccagaaugcgacccacugcuuccagugagaucaugguccuacauuguagaaacaccaaacucugagaauggaauauguuauccaggagauuucaucgacuaugaggagcugagggagcaauugagcucagugucaucauucgaaagauucgaaauauuucccaaagaaagcucauggcccaaccacaacacaaacggaguaacggcagcaugcucccaugaggggaaaagcaguuuuuacagaaauuugcuauggcugacggagaaggagggcucauacccaaagcuggaaaauucuuaugugaacaaaaaagggaaagaaguccuuguacugugggguauucaucacccgccuaacaguaaggaacaacagaaucucuaucagaaugaaaaugcuuaugucucuguagugacuucaaauuauaacaggagauuuaccccggaaauagcaggaagacccaaaguaagagaucaagcugggaggaugaacuauuacuggaccuugcuaaaacccggagacacaauaauauuugaggcaaauggaaaucuaauagcaccaauguaugcuuucgcacugaguagaggcuuuggguccggcaucaucaccucaaacgcaucaaugcaugaguguaacacgaagugucaaacaccccugggagcuauaaacagcagucucccuuaccagaauauacacccagucacaauaggagagugcccaaaauacgucaggagugccaaauugaggaugguuacaggacuaaggaacauuccguccauucaauccagaggucuauuuggagccauugccgguuuuauugaagggggauggacuggaaugauagauggaugguaugguuaucaucaucagaaugaacagggaucaggcuaugcagcggaucaaaaaagcacacaaaaugccauuaacgggauuacaaacaaggugaacacuguuaucgagaaaaugaacauucaauucacagcuguggguaaagaauucaacaaauuagaaaaaaggauggaaaauuuaaauaaaaaaguugaugauggauuucuggacauuuggacauauaaugcagaauuguuaguucuacuggaaaaugaaaggacucuggauuuccaugacucaaaugugaagaaucuguaugagaaaguaaaaagccaauuaaagaauaaugccaaagaaaucggaaauagauguuuugaguucuaccacaagugugacaaugaaugcauggaaaguguaagaaaugggacuuaugauuaucccaaauauucagaagagucaaaguugaacagggaaaagguagauggagugaaauuggaaucaauggggaucuaucagauucuggcgaucuacucaacugucgccaguucacuggugcuuuuggucucccugggggcaaucaguuucuggauguguucuaauggaucuuugcagugcagaauaugcaucuga

SEQ ID NO: 37075 - RNA, 1698 nt, Artificial Sequence
  hemagglutinin__InfluenzaA__ADX99964
augaaggcaaaccuacugguccuguuaugugcacuugcagcugcagaugcagacacaauauguauaggcuaccaugcgaacaauucaaccgacacuguugacacaguacucgagaagaaugugacagugacacacucuguuaaccugcucgaagacagccacaacggaaaacuauguagauuaaaaggaauagccccacuacaauuggggaaauguaacaucgccggauggcucuugggaaacccagaaugcgacccacugcuuccagugagaucaugguccuacauuguagaaacaccaaacucugagaauggaauauguuauccaggagauuucaucgacuaugaggagcugagggagcaauugagcucagugucaucauucgaaagauucgaaauauuucccaaagaaagcucauggcccaaacacaacacaaacggaguaacggcagcaugcucccaugaggggaaaagcaguuuuuacagaaauuugcuauggcugacggagaaggagggcucauacccaaagcugaaaaauucuuaugugaacaaaaaagggaaagaaguccuuguacugugggguauucaucacccgccuaacaguaaggaacaacagaaucucuaucagaaugaaaaugcuuaugucucuguagugacuucaaauuauaacaggagauuuaccccggaaauagcagaaagacccaaaguaagagaucaagcugggaggaugaacuauuacuggaccuugcuaaaacccggagacacaauaauauuugaggcaaauggaaaucuaauagcaccaauguaugcuuucgcacugaguagaggcuuuggguccggcaucaucaccucaaacgcaucaaugcaugaguguaacacgaagugucaaacaccccugggagcuauaaacagcagucucccuuaccagaauauacacccagucacaauaggagagugcccaaaauacgucaggagugccaaauugaggaugguuacaggacuaaggaacauuccguccauucaauccagaggucuauuuggagccauugccgguuuuauugaagggggauggacuggaaugauagauggaugguaugguuaucaucaucagaaugaacagggaucaggcuaugcagcggaucaaaaaagcacacaaaaugccauuaacgggauuacaaacaaggugaacacuguuaucgagaaaaugaacauucaauucacagcuguggguaaagaauucaacaaauuagaaaaaaggauggaaaauuuaaauaaaaaaguugaugauggauuucuggacauuuggacauauaaugcagaauuguuaguucuacuggaaaaugaaaggacucuggauuuccaugacucaaaugugaagaaucuguaugagaaaguaaaaagccaauuaaagaauaaugccaaagaaaucggaaauggauguuuugaguucuaccacaagugugacaaugaaugcauggaaaguguaagaaaugggacuuaugauuaucccaaauauucagaagagucaaaguugaacagggaaaagguagauggagugaaauuggaaucaauggggaucuaucagauucuggcgaucuacucaacugucgccaguucacuggugcuuuuggucucccugggggcaaucaguuucuggauguguucuaauggaucuuugcagugcagaauaugcaucuga

SEQ ID NO: 37076 - RNA, 1698 nt, Artificial Sequence
  hemagglutinin__InfluenzaA__ADX99975
augaaggcaaaccuacugguccuguuaugugcacuugcagcugcagaugcagacacaauauguauaggcuaccaugcgaacaauucaaccgacacuguugacacaguacucgagaagaaugugacagugacacacucuguuaaccugcucgaagacagccacaacggaaaacuauguagauuaaaaggaauagccccacuacaauuggggaaauguaacaucgccggauggcucuugggaaacccagaaugcgacccacugcuuccagugagaucaugguccuacauuguagaaacaccaaacucugagaauggaauauguuauccaggagauuucaucgacuaugaggagcugagggagcaauugagcucagugucaucauucgaaagauucgaaauauuucccaaagaaagcucauggcccaaccacaacacaaacggaguaacggcaacaugcucccaugaggggaaaagcaguuuuuacagaaauuugcuauggcugacggagaaggagggcucauacccagagcugaaaaauucuuaugugaacaaaaaagggaaagaaguccuuguacugugggguauucaucacccgccuaacaguaaggaacaacagaaucucuaucagaaugaaaaugcuuaugucucuguagugacuucaaauuauaacaggagauuuaccccggaaauagcagaaagacccaaaguaagagaucaagcugggaggaugaacuauuacuggaccuugcuaaaacccggagacacaauaauauuugaggcaaauggaaaucuaauagcaccaauguaugcuuucgcacugaguagaggcuuuggguccggcaucaucaccucaaacgcaucaaugcaugaguguaacacgaagugucaaacaccccugggagcuauaaacagcagucucccuuaccagaauauacacccagucacaauaggagagugcccaaaauacgucaggagugccaaauugaggaugguuacaggacuaaggaacauuccguccauucaauccagaggucuauuuggagccauugccgguuuuauugaagggggauggacuggaaugauagauggaugguaugguuaucaucaucagaaugaacagggaucaggcuaugcagcggaucaaaaaagcacacaaaaugccauuaacgggauuacaaacaaggugaacacuguuaucgagaaaaugaacauucaauucacagcuguggguaaagaauucaacaaauuagaaaaaaggauggaaaauuuaaauaaaaaaguugaugauggauuucuggacauuuggacauauaaugcagaauuguuaguucuacuggaaaaugaaaggacucuggauuuccaugacucaaaugugaagaaucuguaugagaaaguaaaaagccaauuaaagaauaaugccaaagaaaucggaaauggauguuuugaguucuaccacaagugugacaaugaaugcauggaaaguguaagaaaugggacuuaugauuaucccaaauauucagaagagucaaaguugaacagggaaaagguagauggagugaaauuggaaucaauggggaucuaucagauucuggcgaucuacucaacugucgccaguucacuggugcuuuuggucucccugggggcaaucaguuucuggauguguucuaauggaucuuugcagugcagaauaugcaucuga

SEQ ID NO: 37077 - RNA, 1698 nt, Artificial Sequence
  hemagglutinin__InfluenzaA__ADX99986
augaaggcaaaccuacugguccuguuaugugcacuugcagcugcagaugcagacacaauauguauaggcuaccaugcgaacaauucaaccgacacuguugacacaguacucgagaagaaugugacagugacacacucuguuaaccugcucgaagacagccacaacggaaaacuauguagauuaaaaggaauagccccacuacaauuggggaaauguaacaucgccggauggcucuugggaaacccaaaaugcgacccacugcuuccagugagaucaugguccuacauuguagaaacaccaaacucugagaauggaauauguuauccaggagauuucaucgacuaugaggagcugagggagcaauugagcucagugucaucauucgaaagauucgaaauauuucccaaagaaagcucauggcccaaccacaacacaaacggaguaacggcagcaugcucccaugaggggaaaagcaguuuuuacagaaauuugcuauggcugacggagaaggagggcucauacccaaagcuggaaaauucuuaugugaacaaaaaagggaaagaaguccuuguacugugggguauucaucacccgccuaacaguaaggaacaacagaaucucuaucagaaugaaaaugcuuaugucucuguagugacuucaaauuauaacaggagauuuaccccggaaauagcagaaagacccaaaguaagagaucaagcugggaggaugaacuauuacuggaccuugcuaaaacccggagacacaauaauauuugaggcaaauggaaaucuaauagcaccaauguaugcuuucgcacugaguagaggcuuuggguccggcaucaucaccucaaacgcaucaaugcaugaguguaacacgaagugucaaacaccccugggagcuauaaacagcagucucccuuaccagaauauacacccagucacaauaggagagugcccaaaauacgucaggagugccaaauugaggaugguuacaggacuaaggaacauuccguccauucaauccagaggucuauuuggagccauugccgguuuuauugaagggggauggacuggaaugauagauggaugguaugguuaucaucaucagaaugaacagggaucaggcuaugcagcggaucaaaaaagcacacaaaaugccauuaacgggauuacaaacaaggugaacacuguuaucgagaaaaugaacauucaauucacagcuguggguaaagaauucaacaaauuagaaaaaaggauggaaaauuuaaauaaaaaaguugaugauggauuucuggacauuuggacauauaaugcagaauuguuaguucuacuggaaaaugaaaggacucuggauuuccaugacucaaaugugaagaaucuguaugagaaaguaaaaagccaauuaaagaauaaugccaaagaaaucggaaauggauguuuugaguucuaccacaagugugacaaugaaugcauggaaaguguaagaaaugggacuuaugauuaucccaaauauucagaagagucaaaguugaacagggaaaagguagauggagugaaauuggaaucaauggggaucuaucagauucuggcgaucuacucaacugucgccaguucacuggugcuuuuggucucccugggggcaaucaguuucuggauguguucuaauggaucuuugcagugcagaauaugcaucuga

SEQ ID NO: 37078 - RNA, 1698 nt, Artificial Sequence
  hemagglutinin__InfluenzaA__ADX99997
augaaggcaaaccuacugguccuguuaugugcacuugcagcugcagaugcagacacaauauguauaggcuaccaugcgaacaauucaaccgacacuguugacacaguacucgagaagaaugugacagugacacacucuguuaaccugcucgaagacagccacaacggaaaacuauguagauuaaaaggaauagccccacuacaauuggggaaauguaacaucgccggauggcucuugggaaacccagaaugcgacccacugcuuccagugagaucaugguccuacauuguagaaacaccaaacucugagaauggaauauguuauccaggagauuucaucgacuaugaggagcugagggagcaauugagcucagugucaucauucgaaagauucgaaauauuucccaaagaaagcucauggcccaaccacaacacaaacggaguaacggcagcaugcucccaugaggggaaaagcaguuuuuacagaaauuugcuauggcugacggagaaggagggcucauacccaaagcuggaaaauucuuaugugaacaaaaaagggaaagaaguccuuguacugugggguauucaucacccgccuaacaguaaggaacaacagaaucucuaucagaaugaaaaugcuuaugucucuguagugacuucaaauuauaacaggagauuuaccccggaaauagcagaaagacccaaaguaagagaucaagcugggaggaugaaauauuacuggaccuugcuaaaacccggagacacaauaauauuugaggcaaauggaaaucuaauagcaccaauguaugcuuucgcacugaguagaggcuuuggguccggcaucaucaccucaaacgcaucaaugcaugaguguaacacgaagugucaaacaccccugggagcuauaaacagcagucucccuuaccagaauauacacccagucacaauaggagagugcccaaaauacgucaggagugccaaauugaggaugguuacaggacuaaggaacauuccguccauucaauccagaggucuauuuggagccauugccgguuuuauugaagggggauggacuggaaugauagauggaugguaugguuaucaucaucagaaugaacagggaucaggcuaugcagcggaucaaaaaagcacacaaaaugccauuaacgggauuacaaacaaggugaacacuguuaucgagaaaaugaacauucaauucacagcuguggguaaagaauucaacaaauuagaaaaaaggauggaaaauuuaaauaaaaaaguugaugauggauuucuggacauuuggacauauaaugcagaauuguuaguucuacuggaaaaugaaaggacucuggauuuccaugacucaaaugugaagaaucuguaugagaaaguaaaaagccaauuaaagaauaaugccaaagaaaucggaaauggauguuuugaguucuaccacaagugugacaaugaaugcauggaaaguguaagaaaugggacuuaugauuaucccaaauauucagaagagucaaaguugaacagggaaaagguagauggagugaaauuggaaucaauggggaucuaucagauucuggcgaucuacucaacugucgccaguucacuggugcuuuuggucucccugggggcaaucaguuucuggauguguucuaauggaucuuugcagugcagaauaugcaucuga

SEQ ID NO: 37079 - RNA, 1698 nt, Artificial Sequence
  hemagglutinin__InfluenzaA__ADY00009
augaaggcaaaccuacugguccuguuaugugcacuugcagcugcagaugcagacacaauauguauaggcuaccaugcgaacaauucaaccgacacuguugacacaguacucgagaagaaugugacagugacacacucuguuaaccugcucgaagacagccacaacggaaaacuauguagauuaaaaggaauagccccacuacaauuggggaaauguaacaucgccggauggcucuugggaaacccagaaugcgacccacugcuuccagugagaucaugguccuacauuguagaaacaccaaacucugagaauggaauauguuauccaggagauuucaucgacuaugaggagcugagggagcaauugagcucagugucaucauucgaaagauucgaaauauuucccaaagaaagcucauggcccaaccacaacacaaacggaguaacggcagcaugcucccaugaggggaaaagcaguuuuuacagaaauuugcuauggcugacggagaagaagggcucauacccaaagcuggaaaauucuuaugugaacaaaaaagggaaagaaguccuuguacugugggguauucaucacccgccuaacaguaaggaacaacagaaucucuaucagaaugaaaaugcuuaugucucuguagugacuucaaauuauaacaggagauuuaccccggaaauagcagaaagacccaaaguaagagaucaagcugggaggaugaacuauuacuggaccuugcuaaaacccggagacacaauaauauuugaggcaaauggaaaucuaauagcaccaauguaugcuuucgcacugaguagaggcuuuggguccggcaucaucaccucaaacgcaucaaugcaugaguguaacacgaagugucaaacaccccugggagcuauaaacagcagucucccuuaccagaauauacacccagucacaauaggagagugcccaaaauacgucaggagugccaaauugaggaugguuacaggacuaaggaacauuccguccauucaauccagaggucuauuuggagccauugccgguuuuauugaagggggauggacuggaaugauagauggaugguaugguuaucaucaucagaaugaacagggaucaggcuaugcagcggaucaaaaaagcacacaaaaugccauuaacgggauuacaaacaaggugaacacuguuaucgagaaaaugaacauucaauucacagcuguggguaaagaauucaacaaauuagaaaaaaggauggaaaauuuaaauaaaaaaguugaugauggauuucuggacauuuggacauauaaugcagaauuguuaguucuacuggaaaaugaaaggacucuggauuuccaugacucaaaugugaagaaucuguaugagaaaguaaaaagccaauuaaagaauaaugccaaagaaaucggaaauggauguuuugaguucuaccacaagugugacaaugaaugcauggaaaguguaagaaaugggacuuaugauuaucccaaauauucagaagagucaaaguugaacagggaaaagguagauggagugaaauuggaaucaauggggaucuaucagauucuggcgaucuacucaacugucgccaguucacuggugcuuuuggucucccugggggcaaucaguuucuggauguguucuaauggaucuuugcagugcagaauaugcaucuga

SEQ ID NO: 37080 - RNA, 1698 nt, Artificial Sequence; identical to SEQ ID NO: 33782
  hemagglutinin__InfluenzaA__ADY00020

SEQ ID NO: 37081 - RNA, 1698 nt, Artificial Sequence
  hemagglutinin__InfluenzaA__ADY04727
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauuccccaaaggaagcucauggcccaaccacaccgugaccggaguaucagcaucaugcucccauaaugggaaaagcaguuuuuacagaaauuugcuauggcugacggggaaaaaugguuuguacccaaaccugagcauguccuauguaaacaacaaagaaaaagaaguccuugugcuaugggguguucaucacccaccuaacauagggaaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaaugggugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaaggaggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaauuugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 37082 - RNA, 1701 nt, Artificial Sequence; identical to SEQ ID NO: 34117
  hemagglutinin__InfluenzaA__ADY11836

SEQ ID NO: 37083 - RNA, 1701 nt, Artificial Sequence; identical to SEQ ID NO: 34094
  hemagglutinin__InfluenzaA__ADY17654

SEQ ID NO: 37084 - RNA, 1701 nt, Artificial Sequence
  hemagglutinin__InfluenzaA__ADY17665
augaagacuaucauugcuuugagcuacauucuaugucugauuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaagacggaacaagcucugcuugcauaaggagaucuaaaaacaguuucuuuaguagauugaauugguugacccacuuaaacuucaaauacccagcauuaaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37085 - RNA, 1701 nt, Artificial Sequence; identical to SEQ ID NO: 34117
  hemagglutinin__InfluenzaA__ADY17676

SEQ ID NO: 37086 - RNA, 1701 nt, Artificial Sequence
  hemagglutinin__InfluenzaA__ADY17687
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaagacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuugugcugcuuuguugggguucaucaugugggccugccaaaaaggcaacauuaggugcaacauuugcauuuga

SEQ ID NO: 37087 - RNA, 1701 nt, Artificial Sequence
  hemagglutinin__InfluenzaA__ADY17698
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaagacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccagguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37088 - RNA, 1701 nt, Artificial Sequence
  hemagglutinin__InfluenzaA__ADY38719
augaagacuaucauugcuuugagcuacauucuaugucugguuuucacucaaaaacuuccuggaaaugacaacagcacggcaacgcugugccuugggcaccaugcaguaccaaacggaacgauagugaaaacaaucacgaaugaccaaauugaaguuacgaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37089 - RNA, 1701 nt, Artificial Sequence
  hemagglutinin__InfluenzaA__ADY38750
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagauggaguaaagcuggaaucaacaaggauuuaccagauuuuggcgaucuauucaacugucgccaguucauugguacugguagucucccugggggcaaucaguuucuggaugugcucuaaugggucucuacaauguagaauauguauuuaa

SEQ ID NO: 37090 - RNA, 1701 nt, Artificial Sequence; identical to SEQ ID NO: 34795
  hemagglutinin__InfluenzaA__ADY38760

SEQ ID NO: 37091 - RNA, 1701 nt, Artificial Sequence
  hemagglutinin__InfluenzaA__ADZ04607
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggguuuaccagauuuuggcgaucuauucaacugucgccaguucauugguacugguagucucccugggggcaaucaguuucuggaugugcucuaaugggucucuacaguguagaauauguauuuaa

SEQ ID NO: 37092 - RNA, 1698 nt, Artificial Sequence; identical to SEQ ID NO: 36467
  hemagglutinin__InfluenzaA__ADZ05834

SEQ ID NO: 37093 - RNA, 1698 nt, Artificial Sequence
  hemagglutinin__InfluenzaA__ADZ05845
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugaggacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccaggacauuucgcugacuaugaggaacugagggagcaauugaguucaguaucuucauuugagagguucgaaauauuccccaaagaaagcucauggcccaaccacaccguaaccggagugucagcaucaugcucccauaauggggaaaacaguuuuuacagaaauuugcuauggcugacggggaagaaugguuuguacccaaaccugagcaaguccuaugcaaacaacaaagaaaaagaaguccuuguacuaugggguguucaucacccgccaaacauggcugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucaaggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 37094 - RNA, 1701 nt, Artificial Sequence; identical to SEQ ID NO: 35625
  hemagglutinin__InfluenzaA__ADZ05855

SEQ ID NO: 37095 - RNA, 1701 nt, Artificial Sequence
  hemagglutinin__InfluenzaA__ADZ47838
augaaggcaauacuaguaguucugcuauauacacuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauucgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauuuguacugauagucucccugggggcaaucaguuucuggaugugcucuaaugggucucuacaauguagaauauguauuuaa

SEQ ID NO: 37096 - RNA, 1701 nt, Artificial Sequence; identical to SEQ ID NO: 34345
  hemagglutinin__InfluenzaA__ADZ47858

SEQ ID NO: 37097 - RNA, 1698 nt, Artificial Sequence
  hemagglutinin__InfluenzaA__ADZ53100
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagacaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaagcauaaaugaucaaaagacccucuaccauacagaaaaugcuuauguuucuguagugucuucacauuauagcagaaaauucaccccagaaauagccaaaagacccaaaguaagagaucaagaaggaagaaucaacuacuacuggacucugcuugaacccagggauacgauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 37098 - RNA, 1701 nt, Artificial Sequence
  hemagglutinin__InfluenzaA__ADZ53123
augaaggcaauacuagugguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauucgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37099 - RNA, 1701 nt, Artificial Sequence
  hemagglutinin__InfluenzaA__ADZ53125
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccuaaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37100 - RNA, 1701 nt, Artificial Sequence
  hemagglutinin__InfluenzaA__ADZ53127
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacgacagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggguucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugugauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37101 - RNA, 1701 nt, Artificial Sequence; identical to SEQ ID NO: 33905
  hemagglutinin__InfluenzaA__ADZ53131

SEQ ID NO: 37102 - RNA, 1701 nt, Artificial Sequence; identical to SEQ ID NO: 33472
  hemagglutinin__InfluenzaA__ADZ53133

SEQ ID NO: 37103 - RNA, 1701 nt, Artificial Sequence; identical to SEQ ID NO: 37099
  hemagglutinin__InfluenzaA__ADZ53135

SEQ ID NO: 37104 - RNA, 1701 nt, Artificial Sequence; identical to SEQ ID NO: 34337
  hemagglutinin__InfluenzaA__ADZ53138

SEQ ID NO: 37105 - RNA, 1701 nt, Artificial Sequence; identical to SEQ ID NO: 34753
  hemagglutinin__InfluenzaA__ADZ53140

SEQ ID NO: 37106 - RNA, 1701 nt, Artificial Sequence; identical to SEQ ID NO: 37098
  hemagglutinin__InfluenzaA__ADZ93496

SEQ ID NO: 37107 - RNA, 1689 nt, Artificial Sequence; identical to SEQ ID NO: 32854
  hemagglutinin__InfluenzaA__AEA04365

SEQ ID NO: 37108 - RNA, 1689 nt, Artificial Sequence
  hemagglutinin__InfluenzaA__AEA04376
auggccaucauuuaucucauucuccuguucacagcagugagaggggaccagauaugcauuggauaccaugccaauaauuccacagagaaggucgacacaauucuagagcggaacgucacugugacucaugccaaggacauucuugagaagacccauaacggaaaguuaugcaaacuaaacggaaucccuccacuugaacuaggggacuguagcauugccggauggcuccuuggaaauccagaaugugauaggcuucuaagugugccagaaugguccuauauaauggagaaagaaaacccgagagacgguuuguguuauccaggcagcuucaaugauuaugaagaauugaaacaucuccucagcagcgugaaacauuucgagaaaguaaagauucugcccaaagauagauggacacagcauacaacaacuggagguucacgggccugcgcggugucugguaauccaucauucuucaggaacauggucuggcugacagagaaaggaucaaauuauccgguugccaaaggaucguacaacaauacaagcggagaacaaaugcuaauaauuuggggggugcaccaucccaaugaugagacagaacaaagaacauuguaccagaaugugggaaccuauguuuccguaggcacaucaacauugaacaaaaggucaaccccagaaauagcaacaaggccuaaagugaauggacaaggagguagaauggaauucucuuggacccucuuggauaugugggacaccauaaauuuugagaguacugguaaucuaauugcaccagaguauggauucaaaauaucgaaaagagguaguucagggaucaugaaaacagaaggaacacuugagaacugugagaccaaaugccaaacuccuuugggagcaauaaauacaacauugccuuuucacaauguccacccacugacaauaggugagugccccaaauauguaaaaucggagaaguuggucuuagcaacaggacuaaggaauguuccccagauugaaucaagaggauuguuuggggcaauagcugguuuuauagaaggaggauggcaaggaaugguugaugguugguauggauaccaucacagcaaugaccagggaucaggguaugcagcagacaaagaauccacucaaaaggcauuugauggaaucaccaacaagguaaauucugugauugaaaagaugaacacccaauuugaagcuguugggaaagaauucaguaacuuagagagaagacuggagaacuugaacaaaaagguggaagacggguuucuagauguguggacauacaaugcugagcuucuaguucugauggaaaaugagaggacacuugacuuucaugauucuaaugucaagaaucuguaugauaaagucagaaugcagcugagagacaacgucaaagaacuaggaaauggauguuuugaauuuuaucacaaaugugaugaugaaugcaugaauagugugaaaaacgggacguaugauuaucccaaguaugaagaagagucuaaacuaaauagaaaugaaaucaaagggguaaaauugagcagcauggggguuuaucaaauccuugccauuuaugcuacaguagcagguucucugucacuggcaaucaugauggcugggaucucuuucuggaugugcuccaacgggucucugcagugcaggaucugcauauga

SEQ ID NO: 37109 - RNA, 1698 nt, Artificial Sequence
  hemagglutinin__InfluenzaA__AEA10292
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaaugggaaacuauguucauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggugaagaaugguuuguacccaaacuugagcaaguccuaugcaaacaacaaagaaaaagaaguccuuguacuaugggguguucaucacccgccaaacauaguugaccaaaagacccucuaucguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucggggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaaccuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 37110 - RNA, 1701 nt, Artificial Sequence
  hemagglutinin__InfluenzaA__AEA10303
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggguuuaccagauuuuggcgaucuauucaacugucgccaguucauugguacugguagucucccugggggcaaucaguuucuggaugugcucuaaugggucucuacaguguagaauauguauuuaa

SEQ ID NO: 37111 - RNA, 1701 nt, Artificial Sequence
  hemagglutinin__InfluenzaA__AEA10313
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccuggggaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaacuccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccagcccacgauugcaacacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37112 - RNA, 1701 nt, Artificial Sequence; identical to SEQ ID NO: 34795
  hemagglutinin__InfluenzaA__AEA10323

SEQ ID NO: 37113 - RNA, 1701 nt, Artificial Sequence; identical to SEQ ID NO: 35516
  hemagglutinin__InfluenzaA__AEA10339

SEQ ID NO: 37114 - RNA, 1701 nt, Artificial Sequence
  hemagglutinin__InfluenzaA__AEA10349
augaaggcaauacuaauaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacggaaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37115 - RNA, 1701 nt, Artificial Sequence
  hemagglutinin__InfluenzaA__AEA30293
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugcagaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuaccccaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37116 - RNA, 1701 nt, Artificial Sequence
  hemagglutinin__InfluenzaA__AEA48989
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucugugucaucauuugaaagguuugagauauuccccaagacaaguucauggcccaaucaugaaucgaacaaagguguaacggcagcauguccucaugcuggagcaagaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaguuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37117 - RNA, 1707 nt, Artificial Sequence
  hemagglutinin__InfluenzaA__AEA50985
auggagaaaauagugcuucuucuugcaauuaucaaucuuguuaaaagugaucagauuugcauugguuaccaugcaaacaacucgacagagcagguugacacaauaauggaaaagaacgucacuguuacacacgcccaagacauacuggaaaagacacacaacgggaagcucugugaucuagacggagugaagccucuaauuuugagagauuguaguguagcuggauggcuccucgggaauccaaugugugacgaauuccucaaugugccggaauggucuuacauaguggaaaagaucaauccagccaaugaccucuguuacccagggaauuucaacgacuaugaagaacugaaacaccuacugagcagaaucaaccauuuugagaaaauucagaucauccccaaaaguucuuggucagaucaugaagccucaucaggggugagcucagcauguccguaccagggaagguccuccuuuuuuagaaaugugguauggcuuaucaaaaagaacgaugcauacccaacaauaaagauaaguuacaauaauaccaaccaagaagaucuuuugguauugugggggauucaccauccaaaugaugcggcagagcagacaaaacuuuaucaaaauccaaccaccuauauuuccguugggacaucaacacuuaaucugagauugguaccaaaaauagcuacuagauccaaaguaaacgggcaaaguggaaggauggaguucuuuuggacaauuuuaaaaccaaaugaugcaauaaauuuugagaguaauggaaauuucauugcuccagaaaaugcauacaaaauugucaagaaaggggacucaacgaucaugaaaagugaauuggaauauggcaacugcaacaccaagugucaaacuccaguaggggcgauaaacucuaguaugccauuccacaacauccacccucucaccauaggggaaugccccaaauaugugaaaucaaacagauuaguucuugcgacugggcucagaaauagcccucaaggagaaagaagaagaaaaaagagaggacuauuuggagcuauagcaggcuuuauagagggaggauggcagggaaugguagaugguugguauggguaccaccauaguaacgagcaggggaguggguacgcugcagacaaagaauccacucaaaaggcaauaaauggagucaccaauaaggucaacucgaucauugacaaaaugaacacucaguuugaggccguuggaagggaauuuaauaacuuagaaaggagaauagaaaauuuaaacaagaagauggaagacggauuucuagaugucuggacuuauaaugcugaacuucugguucucauggaaaaugagagaacucuagacuuucaugacucaaaugucaagaaucuuuacgauaaaguccgacuacagcuuagagauaaugcaaaggagcuugguaacgguuguuucgaguucuaccacagaugugauaaugaauguauggaaaguguuagaaacggaacguaugacuacccucaguauucagaagaaucaagauuaaaaagagaggaaauaaguggaguaaaauuggagucaauaggaauuuaucaaauacugucaauuuauucaacagcggcgagcucccuagcacuggcaaucaugguggcuggucuaucuuuauggaugugcuccaauggaucauuacaaugcagaauuugcauuuaa

SEQ ID NO: 37118 - RNA, 1701 nt, Artificial Sequence; identical to SEQ ID NO: 36037
  hemagglutinin__InfluenzaA__AEA72704

SEQ ID NO: 37119 - RNA, 1701 nt, Artificial Sequence
  hemagglutinin__InfluenzaA__AEA72715
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaaguggaaaaagcucaauaaugagaucagaugcacccauuggcaaaugcaauucugaaugcaucacuccaaauggaagcauucccaaugacaaaccauuccaaaauguaaacaggaucacauacggggccugccccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucacaauauaccacaaaugugacaaugccugcauaggaucaaucagaaauggaacuuaugaccacaauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37120 - RNA, 1701 nt, Artificial Sequence; identical to SEQ ID NO: 36037
  hemagglutinin__InfluenzaA__AEA72726

SEQ ID NO: 37121 - RNA, 1701 nt, Artificial Sequence
  hemagglutinin__InfluenzaA__AEA72740
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaacaagacccaaagugagggaucaagaagggagaaugaacuauuacuggacacuaguagagccgggagacaaaauaacauuugaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 37122 - RNA, 1701 nt, Artificial Sequence
  hemagglutinin__InfluenzaA__AEA72750
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaaacauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggaguuuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37123 - RNA, 1701 nt, Artificial Sequence; identical to SEQ ID NO: 36942
  hemagglutinin__InfluenzaA__AEA72759

SEQ ID NO: 37124 - RNA, 1701 nt, Artificial Sequence
  hemagglutinin__InfluenzaA__AEA72777
augaaggcaauacuaguaguucugcuauauacauuagcaaccgcaaaugcagacacauuauguauagguuaucaugcgaacaauucaacagacacuguagacacaguacuagaaaagaauguaacaguaacacacucuguuaaccuucuagaagacaagcaugacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaagagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaauccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaaugcaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37125 - RNA, 1701 nt, Artificial Sequence; identical to SEQ ID NO: 36942
  hemagglutinin__InfluenzaA__AEA72787

SEQ ID NO: 37126 - RNA, 1701 nt, Artificial Sequence; identical to SEQ ID NO: 36037
  hemagglutinin__InfluenzaA__AEA73288

SEQ ID NO: 37127 - RNA, 1701 nt, Artificial Sequence; identical to SEQ ID NO: 36037
  hemagglutinin__InfluenzaA__AEA73299

SEQ ID NO: 37128 - RNA, 1701 nt, Artificial Sequence
  hemagglutinin__InfluenzaA__AEA73310
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacgggacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaaguggaaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucacaauauaccacaaaugugacaaugccugcauaggaucaaucagaaauggaacuuaugaccacaauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37129 - RNA, 1701 nt, Artificial Sequence
  hemagglutinin__InfluenzaA__AEA73321
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaaguggaaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguuacccuggagaaccaacauacaauugaucuaacugacucagaaaugaacaaacuguuugaaaaaacaaagaagcaacugagggaaaaugcugaggauaugggcaaugguuguuucacaauauaccacaaaugugacaaugccugcauaggaucaaucagaaauggaacuuaugaccacaauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37130 - RNA, 1701 nt, Artificial Sequence; identical to SEQ ID NO: 36037
  hemagglutinin__InfluenzaA__AEA73332

SEQ ID NO: 37131 - RNA, 1701 nt, Artificial Sequence; identical to SEQ ID NO: 36037
  hemagglutinin__InfluenzaA__AEA73343

SEQ ID NO: 37132 - RNA, 1701 nt, Artificial Sequence; identical to SEQ ID NO: 36037
  hemagglutinin__InfluenzaA__AEA73354

SEQ ID NO: 37133 - RNA, 1701 nt, Artificial Sequence
  hemagglutinin__InfluenzaA__AEA73365
augaagacuaucauugcuuugagcuacacucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacauuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaaguggaaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucacaauauaccacaaaugugacaaugccugcauaggaucaaucagaaauggaacuuaugaccacaauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37134 - RNA, 1701 nt, Artificial Sequence; identical to SEQ ID NO: 36037
  hemagglutinin__InfluenzaA__AEA73376

SEQ ID NO: 37135 - RNA, 1701 nt, Artificial Sequence; identical to SEQ ID NO: 36552
  hemagglutinin__InfluenzaA__AEA73387

SEQ ID NO: 37136 - RNA, 1701 nt, Artificial Sequence; identical to SEQ ID NO: 36037
  hemagglutinin__InfluenzaA__AEA73398

SEQ ID NO: 37137 - RNA, 1701 nt, Artificial Sequence; identical to SEQ ID NO: 36037
  hemagglutinin__InfluenzaA__AEA73409

SEQ ID NO: 37138 - RNA, 1701 nt, Artificial Sequence; identical to SEQ ID NO: 36037
  hemagglutinin__InfluenzaA__AEA73420

SEQ ID NO: 37139 - RNA, 1701 nt, Artificial Sequence; identical to SEQ ID NO: 36037
  hemagglutinin__InfluenzaA__AEA73452

SEQ ID NO: 37140 - RNA, 1701 nt, Artificial Sequence; identical to SEQ ID NO: 36037
  hemagglutinin__InfluenzaA__AEA73463

SEQ ID NO: 37141 - RNA, 1701 nt, Artificial Sequence; identical to SEQ ID NO: 36037
  hemagglutinin__InfluenzaA__AEA73474

SEQ ID NO: 37142 - RNA, 1701 nt, Artificial Sequence
  hemagglutinin__InfluenzaA__AEA73485
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugaacugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaaguggaaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucacaauauaccacaaaugugacaaugccugcauaggaucaaucagaaauggaacuuaugaccacaauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37143 - RNA, 1701 nt, Artificial Sequence; identical to SEQ ID NO: 36037
  hemagglutinin__InfluenzaA__AEA73496

SEQ ID NO: 37144 - RNA, 1701 nt, Artificial Sequence; identical to SEQ ID NO: 36037
  hemagglutinin__InfluenzaA__AEA73507

SEQ ID NO: 37145 - RNA, 1701 nt, Artificial Sequence; identical to SEQ ID NO: 36037
  hemagglutinin__InfluenzaA__AEA73518

SEQ ID NO: 37146 - RNA, 1701 nt, Artificial Sequence; identical to SEQ ID NO: 36037
  hemagglutinin__InfluenzaA__AEA73529

SEQ ID NO: 37147 - RNA, 1701 nt, Artificial Sequence; identical to SEQ ID NO: 36037
  hemagglutinin__InfluenzaA__AEA73540

SEQ ID NO: 37148 - RNA, 1701 nt, Artificial Sequence; identical to SEQ ID NO: 36037
  hemagglutinin__InfluenzaA__AEA73551

SEQ ID NO: 37149 - RNA, 1701 nt, Artificial Sequence; identical to SEQ ID NO: 36037
  hemagglutinin__InfluenzaA__AEA73562

SEQ ID NO: 37150 - RNA, 1698 nt, Artificial Sequence
  hemagglutinin__InfluenzaA__AEA73573
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuuacuauggcugacggagaagaaugguuuguacccaaaccugagcaaguccuaugcaaacaacaaagaaaaagaaguccuuguacuaugggguguucaucacccgccaaacauaggugaccaaaagacccucuaucauacagaaaaugcuuauguuucuguagugucuucacauuauagcagaaaauucaccccagaaauagccaaaagacccaaaguaagagaccaagaaggaagaaucaacuacuacuggacucugcuugaacccggggauacaauaauauuugaggcaaauggaaaucuaauagcgccaagauaugcuuucgcacuaaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 37151 - RNA, 1698 nt, Artificial Sequence
  hemagglutinin__InfluenzaA__AEA73584
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaacuugagcaaguccuaugcaaacaacaaagaaaaagaaguccuuguacuaugggguguucaucacccgccaaacauaguugaccaaaagacccucuaucguacagaaaaugcuuauguuucuguagugucuucacauuauagcagaaaauucaccccagaaauagccaaaagacccaaaguaagaaaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguuaguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 37152 - RNA, 1698 nt, Artificial Sequence
  hemagglutinin__InfluenzaA__AEA73595
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuauguuuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggugaagaaugguuuguacccaaacuugagcaaguccuaugcaaacaacaaagaaaaagaaguccuuguacuaugggguguucaucacccgccaaacauaguugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucggggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaccacaaguguaacgaugaaugcauggagaguguaaagaauggaaccuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 37153 - RNA, 1698 nt, Artificial Sequence; identical to SEQ ID NO: 36492
  hemagglutinin__InfluenzaA__AEA73606

SEQ ID NO: 37154 - RNA, 1698 nt, Artificial Sequence; identical to SEQ ID NO: 36890
  hemagglutinin__InfluenzaA__AEA73617

SEQ ID NO: 37155 - RNA, 1698 nt, Artificial Sequence
  hemagglutinin__InfluenzaA__AEA73628
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuauguuuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggugaagaaugguuuguacccaaacuugagcaaguccuaugcaaacaacaaagaaaaagaaguccuuguacuaugggguguucaucacccgccaaacauaguugaccaaaagacccucuaucguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucggggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaaccuaugacuauccaaaauauuccgaagaaucaaaguuaaacagggagaaaauugauggagugaaauuggaaucaaugggagucuaucagauccuggcgaucuacucaacagucgccaguucucugguucuuuuggucucccugggggcaaucagcuucuggauguguuccaaugggucuuugcaguguagaauaugcauauaa

SEQ ID NO: 37156 - RNA, 1698 nt, Artificial Sequence
  hemagglutinin__InfluenzaA__AEA73639
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacugugucuauuaaaaggaauagccccacuacaauuggguaacugcagcguugccggguggaucuuaggaaauccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagaaguuuuuacagaaauuugcuauggcugacggggaagaaugguuuguacccaaaccugagcaaguccuaugcaaacaacaaagaaaaagaaguccuuguacuaugggguguucaucacccgccagacauaggugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacuggacuaaggaacaucccauccauucaauccagagguuuguuuggagccauugccgguuucauugaagggggguggacuggaaugguagaugguugguaugguuaucaucaucagaaugagcaagggucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugauuccaaugugaagaaucuguaugagaaaguaaaaagccaguuaaagaauaaugcuaaagaaauaggaaauggguguuuugaauucuaucacaaguguaacgaugagugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucaguuucuggauguguuccaaugggucuuugcaguguagaauaugcaucuaa

SEQ ID NO: 37157 - RNA, 1698 nt, Artificial Sequence; identical to SEQ ID NO: 36890
  hemagglutinin__InfluenzaA__AEA73650

SEQ ID NO: 37158 - RNA, 1698 nt, Artificial Sequence; identical to SEQ ID NO: 36893
  hemagglutinin__InfluenzaA__AEA73661

SEQ ID NO: 37159 - RNA, 1698 nt, Artificial Sequence
  hemagglutinin__InfluenzaA__AEA73672
augaaaguaaaacuacugguccuguuaugcacauuuacagcuacauuugcagacacaauauguauaggcuaccaugcuaacaacucgaccgacacuguugacacaguacuugaaaagaaugugacagugacacacucugucaaccugcuugagaacagucacaaugggaaacuauguuuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggugaagaaugguuuguacccaaacuugagcaaguccuaugcaaacaacaaagaaaaagaaguccuuguacuaugggguguucaucacccgccaaacauaguugaccaaaagacccucuaucguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucggggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaaccuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 37160 - RNA, 1698 nt, Artificial Sequence; identical to SEQ ID NO: 36919
  hemagglutinin__InfluenzaA__AEA73683

SEQ ID NO: 37161 - RNA, 1698 nt, Artificial Sequence
  hemagglutinin__InfluenzaA__AEA73694
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaaugggaaacuauguuuauuaaaaggaauagccccacuacaauugggaaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggugaagaaugguuuguacccaaacuugagcaaguccuaugcaaacaacaaagaaaaagaaguccuuguacuaugggguguucaucacccgccaaacauaguugaccaaaagacccucuaucguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucggggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaaccuaugacuauccaaaauauuccgaagaaucaaaguuaaacagggagaaaauugauggaguggaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 37162 - RNA, 1698 nt, Artificial Sequence; identical to SEQ ID NO: 36893
  hemagglutinin__InfluenzaA__AEA73705

SEQ ID NO: 37163 - RNA, 1698 nt, Artificial Sequence; identical to SEQ ID NO: 36890
  hemagglutinin__InfluenzaA__AEA73716

SEQ ID NO: 37164 - RNA, 1698 nt, Artificial Sequence; identical to SEQ ID NO: 36890
  hemagglutinin__InfluenzaA__AEA73727

SEQ ID NO: 37165 - RNA, 1698 nt, Artificial Sequence; identical to SEQ ID NO: 36890
  hemagglutinin__InfluenzaA__AEA73738

SEQ ID NO: 37166 - RNA, 1698 nt, Artificial Sequence; identical to SEQ ID NO: 36890
  hemagglutinin__InfluenzaA__AEA73749

SEQ ID NO: 37167 - RNA, 1698 nt, Artificial Sequence
  hemagglutinin__InfluenzaA__AEA73760
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaaugggaaacuauguuuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggugaagaaugguuuguacccaaacuugagcaaguccuaugcaaacaacaaagaaaaagaaguccuuguacuaugggguguucaucacccgccaaacauaguugaccaaaagacccucuaucguacagaaaaugcuuauguuucuguagugucuucacauuauagcagaaaauucaccccagaaauagccaaaagacccaaaauaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucggggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaaccuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 37168 - RNA, 1701 nt, Artificial Sequence; identical to SEQ ID NO: 33173
  hemagglutinin__InfluenzaA__AEA73771

SEQ ID NO: 37169 - RNA, 1701 nt, Artificial Sequence; identical to SEQ ID NO: 34810
  hemagglutinin__InfluenzaA__AEA73781

SEQ ID NO: 37170 - RNA, 1701 nt, Artificial Sequence; identical to SEQ ID NO: 34731
  hemagglutinin__InfluenzaA__AEA73791

SEQ ID NO: 37171 - RNA, 1701 nt, Artificial Sequence
  hemagglutinin__InfluenzaA__AEA73801
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugauucgaacaaagguguaacggcagcauguccucaugcuggagcaaaaagcuucuacaaaaauuuaauauggcuaguuaagaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaucaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37172 - RNA, 1701 nt, Artificial Sequence
  hemagglutinin__InfluenzaA__AEA73811
augaaagcaauacuaguaguucugcuauauacauuugcaaccgcaaaugcagacacauuauguauagguuaccaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcagggaucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagauggggugaagcuggaaucaacaaggauuuaccagauuuuggcgaucuauucaacugucgccaguucauugguacugguagucucccugggggcaaucaguuucuggauguguucuaaugggucucuacaguguagaauauguauuuaa

SEQ ID NO: 37173 - RNA, 1701 nt, Artificial Sequence
  hemagglutinin__InfluenzaA__AEA73821
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucauuauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37174 - RNA, 1701 nt, Artificial Sequence
  hemagglutinin__InfluenzaA__AEA73831
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguaaccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuaguacugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaauccagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37175 - RNA, 1701 nt, Artificial Sequence
  hemagglutinin__InfluenzaA__AEA73841
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcugcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcugaaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuguugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37176 - RNA, 1701 nt, Artificial Sequence; identical to SEQ ID NO: 34810
  hemagglutinin__InfluenzaA__AEA73851

SEQ ID NO: 37177 - RNA, 1701 nt, Artificial Sequence
  hemagglutinin__InfluenzaA__AEA73861
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuugggugaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauguacauccgaucacaauuggaaaauguccaaaauauguaaaaagcacaaaauugagacuggccacaggauugaggaaugucccaucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugaugagauuacuaacaaaguaaauucuguuauugaaaagaugaauacacaguucacagcaguagguaaagaguucaaccaccuggaaaaaagaauagagaauuuaaauaaaaagauugaugaugguuuccuagacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37178 - RNA, 1701 nt, Artificial Sequence; identical to SEQ ID NO: 36642
  hemagglutinin__InfluenzaA__AEA73871

SEQ ID NO: 37179 - RNA, 1701 nt, Artificial Sequence
  hemagglutinin__InfluenzaA__AEA73881
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguagaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaguccuacauuaaugauaaagggaaagaaguccucgugcuauggggcauucaccauccaucuacuaguacugaccaacaaagucucuaucagaaugcagaugcauauguuuuuguggggacaucaagauacagcaagaaguucaagccggaaauagcaauaagacccaaaguuagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaaaaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37180 - RNA, 1701 nt, Artificial Sequence; identical to SEQ ID NO: 34731
  hemagglutinin__InfluenzaA__AEA73891

SEQ ID NO: 37181 - RNA, 1701 nt, Artificial Sequence
  hemagglutinin__InfluenzaA__AEA73901
augaaugcaauacuaguaguucugcuauauacauuugcaaccgcaaaugcagacacauuauguauagguuaucaugcgaacaauucaacagacacuguagacacauuacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaauaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37182 - RNA, 1701 nt, Artificial Sequence
  hemagglutinin__InfluenzaA__AEA73911
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauucugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcuauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37183 - RNA, 1701 nt, Artificial Sequence; identical to SEQ ID NO: 37179
  hemagglutinin__InfluenzaA__AEA73921

SEQ ID NO: 37184 - RNA, 1701 nt, Artificial Sequence
  hemagglutinin__InfluenzaA__AEA73931
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucggauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacgguugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugauagucucccugggggcaaucaguuucuggaugugcucuaaugggucucuacaguguagaauauguauuuaa

SEQ ID NO: 37185 - RNA, 1701 nt, Artificial Sequence; identical to SEQ ID NO: 34810
  hemagglutinin__InfluenzaA__AEA73961

SEQ ID NO: 37186 - RNA, 1701 nt, Artificial Sequence
  hemagglutinin__InfluenzaA__AEA73971
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagauuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacuucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauucgaucacaauuggaaaauguccaaaauauguaaaaagcacaaaacugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccagaagagcacacagaaugccauugacgagauuacuaacaaaguaaauucuguuauugaaaagaugaauacacaguucacagcaguagguaaagaguucaaccaccuggaaaaaagaauagaaaauuuaaauaaaaaaguugaugaugguuuccuggacauuuggacuuacaaugccgaacuguugguucuauuggaaaaugaaagaacuuuagacuaccacgauucaaaugugaagaacuuauaugaaaagguaagaagccaguuaaaaaacaaugccaaggaaauuggaaacggcuguuuugaauuuuaccacaaaugcaauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37187 - RNA, 1701 nt, Artificial Sequence; identical to SEQ ID NO: 34810
  hemagglutinin__InfluenzaA__AEA73981

SEQ ID NO: 37188 - RNA, 1701 nt, Artificial Sequence
  hemagglutinin__InfluenzaA__AEA73991
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaaaauuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacaucaaugauaaagggaaagaaguccucgugcuauggggcauucaccauccaucuacuagugcugaccaacaaagucucuaucagaaugcagauucauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37189 - RNA, 1701 nt, Artificial Sequence
  hemagglutinin__InfluenzaA__AEA74001
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagauuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaaacucagcaaauccuacaucaaugauaaagggaaagaaguccucgugcuauggggcauucaccauccaucuacuagugcugaccaacaaagucucuaucagaaugcagauucauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37190 - RNA, 1701 nt, Artificial Sequence
  hemagglutinin__InfluenzaA__AEA74011
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaagaaauucauacccaaagcucagccaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaaaguaagaagccaguuaaaaaacaaugccaaggaaauuggaaacggcugcuuugaauuuuaccacaaaugcgauaacacgugcauggaaaguaucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37191 - RNA, 1701 nt, Artificial Sequence
  hemagglutinin__InfluenzaA__AEA74021
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagccaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaaaguaagaagccaguuaaaaaacaaugccaaggaaauuggaaacggcugcuuugaauuuuaccacaaaugcgauaacacgugcauggaaaguaucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37192 - RNA, 1701 nt, Artificial Sequence
  hemagglutinin__InfluenzaA__AEA74031
augaaggcaauacuaguaguucugcuauauacauuugcaaccgcaaaugcagacacauuauguauagguuaucaugcgaacaauucaacagacacuguagacacaguacuagaaaagaauguaacaguaacacauucuguugaccuucuagaagacaagcauaacgggaaacuaugcaaacuaagagggguagccccauugcauuuagguaaauguaacauugcuggcuggauccugggaaauccagagugugaaucacucuccacagcaagcucauggucuuacauuguggaaacaucuaguucagacaauggaacguguuacccaggagauuucaucgauuaugaggagcuaagagagcaauugagcucagugucaucauuugaaagguuugaaauauuccccaagacaaguucauggcccaaucaugacucgaacaaagguguaacggcagcauguccacaugcuggagcaaaaagcuucuacaacaauuuaauauggcuaguuaaaaaaggaaauucauacccaaagcucaacaaauccuacauuaaugauaaagggaaagaaguccucgugcuauggggcauucaccauccaucuacuaguacugaccaacaaagucucuaucagaaugcagaugcauauguuuuuguggggacaucaagauacagcaagaaguuuaagccggaaauagcaauaagacccaaagugaggaaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaauccacgauugcaauacaacuugucagacacccaagggggcuauaaacaccagccucccauuucagaauauacauccgaucacaauuggaaaguguccaaaauauguaaaaagcacaaaauugagacuggccacaggauugaggaaugucccgucuauucaaucuagaggccuauuuggggccauugccgguuucauugaagggggguggacaggaaugguagauggaugguacgguuaucaccaucaaaaugagcaggggucaggauaugcagccgaccugaagagcacacagaaugccauugacgagauuacuaacaaaguaaauucuguuauugaaaagaugaauacgcaguucacagcaguaggcaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37193 - RNA, 1701 nt, Artificial Sequence
  hemagglutinin__InfluenzaA__AEA74035
augaaggcaauacuaguaguucugcuauauacauuugcaaccgcaaaugcagacacauuauguauagguuaucaugcgaacaauucaacagacacuguagacacaguacuagaaaagaauguaacaguaacacauucuguugaccuucuagaagacaagcauaacgggaaacuaugcaaacuaagagggguagccccauugcauuuagguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugaaauauuccccaagacaaguucauggcccaaucaugacucgaacaaagguguaacggcagcauguccacaugcuggagcaaaaagcuucuacaacaauuuaauauggcuaguuaaaaaaggaaauucauacccaaagcucaacaaauccuacauuaaugauaaagggaaagaaguccucgugcuauggggcauucaccauccaucuacuaguacugaccaacaaagucucuaucagaaugcagaugcauauguuuuuguggggacaucaagauacagcaagaaguuuaagccggaaauagcaauaagacccaaagugagggaucaagaagggagaaugaacuauuacuggacacuaguagagccgggagacaaaauaacauucgaagcaacuggaaaucuaguggugccgagauaugcauucgcaauggaaagaaaugcuggaucugguauuaucauuucagauacaccaauccacgauugcaauacaacuugucagacacccaagggggcuauaaacaccagccucccauuucagaauauacauccgaucacaauuggaaaguguccaaaauauguaaaaagcacaaaauugagacuggccacaggauugaggaaugucccgucuauucaaucuagaggccuauuuggggccauugccgguuucauugaagggggguggacaggaaugguagauggaugguacgguuaucaccaucaaaaugagcaggggucaggauaugcagccgaccugaagagcacacagaaugccauugacgagauuacuaacaaaguaaauucuguuauugaaaagaugaauacgcaguucacagcaguaggcaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37194 - RNA, 1701 nt, Artificial Sequence
  hemagglutinin__InfluenzaA__AEA77299
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugcuugcauaggaucaaucagaaauggaacuuaugaccacgauguauacagagaugaagcauuaaacaaccgguuccagaucaaaggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37195 - RNA, 1701 nt, Artificial Sequence
  hemagglutinin__InfluenzaA__AEB21316
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaagggaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 37196 - RNA, 1701 nt, Artificial Sequence
  hemagglutinin__InfluenzaA__AEB21326
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaaccuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 37197 - RNA, 1701 nt, Artificial Sequence
  hemagglutinin__InfluenzaA__AEB21338
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccaugauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacaggaaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 37198 - RNA, 1701 nt, Artificial Sequence
  hemagglutinin__InfluenzaA__AEB21348
augaaggcaauacuaguaguucugcuauauacauuugcaaccgcaaaugcagacacauuauguauagguuaccaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 37199 - RNA, 1701 nt, Artificial Sequence; identical to SEQ ID NO: 34094
  hemagglutinin__InfluenzaA__AEB40206

SEQ ID NO: 37200 - RNA, 1701 nt, Artificial Sequence
  hemagglutinin__InfluenzaA__AEB66895
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaagacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggagcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37201 - RNA, 1698 nt, Artificial Sequence
  hemagglutinin__InfluenzaA__AEB71102
auggaugucccaguauuuguacucuuaauguuaaccagcauauguguacaggcugauaggauuuguguuggguacuuaagcacaaacucaucagaaaggguugacacauugcuagagaacaaugucccgguuacaagcucuguugauuugguugagaccaaccacacaggaacauauuguucuuuggguggaauuagcccagugcacuugggggacuguagcuucgagggcuggauuguagggaacccugccugugccagcaaccuggggauuagagaauggucauauuugauugaagauccuucugcuccucauggauuguguuacccaggagaguuagacaacaauggagaauugaggcacuuguucagugggaucagaucuuucaguagaacagaguugaucgcaccuaccucuuggggggaagugaaugaugggguaacggcugccugucaagacaaaggagcuagcagcuuuuaccggaacuugguaugguuuguggagagaggaaauaaauauccugugauccgcaggaccuacaacaacaccacuggcagagauguuuugguuauaugggguauacaucacccugucuccacagaugaagcgaggaaacuguaugccaaagacaauccauacacauugguaucuaccaguucauggagcaggaaauacaaccuagaaacuggaaccagaccuggauacaauggccaaaagaguuggacgaagauuuacugguaucugaugcaccccggggauucaaucaguuucgaaagcaaugggggauuacuggcucccaaauaugguuacauuauugaggaauauggaaaagggcgaauuuuccaaagccgcauucgcauugcuaaaugcaauacuaagugccaaacaucgguugguggaauaaauacuaacaaaacauuucaaaacauagagagaaaugcacuuggggauugcccgaaauacauaaagucuggacagcucaaguuggccacuggacuuaggaauguaccugccauaucaaacagaggauuguuuggggcuauugcaggcuucauagaaggugguuggccaggauuaauaaaugguugguauggauuccaacaucagaaugaacaaggaaugggcauggcugcagacaaagagucaacacaaaaggcuauugaucaaauaacaacuaagauaaacaauauaauagaaaaaaugaaugggaauuaugacucaauacgaggugaauucagucagguggaacaaagaauaaauaugcuugcagacagaauagaugaugcuguaacugauguauggucauacaaugcaaagcuucuuguuuuauuagagaacgacaagacucuagacaugcaugacgccaacgucaggaaccugcaugaucaaguccguagaguguugaggaccaaugcaauugaugagggaaauggauguuuugaacuccuccauaaaugcaaugacucuugcauggagacaauaagaaauggaacguacaaccauauagaguaugaagaggaaucaaaguuaaaaagacaggaaauagaagguauaaagcugaagucagacgacaaugucuacaaagcauuaucgauuuacagcugcaucgcaagcaguauuguauugguaggacucauacuugcauucaucaugugggcaugcaguaguggcaauugccgauucaauauuuguauauaa

SEQ ID NO: 37202 - RNA, 1698 nt, Artificial Sequence
  hemagglutinin__InfluenzaA__AEB71896
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaagagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaguugaccaaaagacccucuaccguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggguaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacaaggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 37203 - RNA, 1701 nt, Artificial Sequence; identical to SEQ ID NO: 33457
  hemagglutinin__InfluenzaA__AEB71916

SEQ ID NO: 37204 - RNA, 1701 nt, Artificial Sequence
  hemagglutinin__InfluenzaA__AEB71925
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugauguaccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacaguaucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauccaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauugaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37205 - RNA, 1701 nt, Artificial Sequence
  hemagglutinin__InfluenzaA__AEB71936
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauuaaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuucugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaccuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37206 - RNA, 1701 nt, Artificial Sequence
  hemagglutinin__InfluenzaA__AEB71947
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauuaaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacccaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37207 - RNA, 1698 nt, Artificial Sequence; identical to SEQ ID NO: 37156
  hemagglutinin__InfluenzaA__AEB71958

SEQ ID NO: 37208 - RNA, 1701 nt, Artificial Sequence
  hemagglutinin__InfluenzaA__AEB71969
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37209 - RNA, 1701 nt, Artificial Sequence
  hemagglutinin__InfluenzaA__AEB71980
augaagacuaucauugcuuugagcugcauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuaccgagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuuuaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggugcaaucgcgggcuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguagaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37210 - RNA, 1698 nt, Artificial Sequence; identical to SEQ ID NO: 36893
  hemagglutinin__InfluenzaA__AEB71992

SEQ ID NO: 37211 - RNA, 1698 nt, Artificial Sequence; identical to SEQ ID NO: 36893
  hemagglutinin__InfluenzaA__AEC13313

SEQ ID NO: 37212 - RNA, 1701 nt, Artificial Sequence
  hemagglutinin__InfluenzaA__AEC46553
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauagcuggcuggauccugggaaauccagagugugaaucacucuccacagcaagcucaugguccuacauuguggaaacaucuaguucagacaauggaacguguuacccaggagauuucaucgauuaugaggagcuaagggagcaauugagcucagugucaucauuugaaagauuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcacauccuauauuaaugauaaagggaaagaaguccucgugcuauggggcauucaccauccaucuacuagugcugaccaacaaagucucuaucagaaugcagaugcauaugcuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuaguggugccgagauaugcauucgcaauggaaagaaaugcgggaucugguauuaucauuucagauacaucaguccacgauugcaauacaacuugucaaacacccaagggugcuauaaacaccagccucccauuucagaauguacauccgaucacaauuggaaaauguccaaaauauguaaaaagcacaaaauugagacuggccacaggauugaggaaugucccgucuauucaaucucgaggccuauuuggggccauugccgguuucauugaagggggguggacagggaugguagauggaugguacgguuaucaucaucaaaaugagcaggggucaggauaugcagccgaccugaagagcacacagaaugccuuugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37213 - RNA, 1701 nt, Artificial Sequence
  hemagglutinin__InfluenzaA__AEC46555
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauagcuggcuggauccugggaaauccagagugugaaucacucuccacagcaagcucaugguccuacauuguggaaacaucuaguucagacaauggaacguguuacccaggagauuucaucgauuaugaggagcuaagggagcaauugagcucagugucaucauuugaaagauuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcacauccuauauuaaugauaaagggaaaaaaguacucgugcuauggggcauucaccauccaucuacuagugcugaccaacaaagucucuaucagaaugcagaugcauaugcuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuaguggugccgagauaugcauucgcaauggaaagaaaugagggaucugguauuaucauuucagauacaucaguccacgauugcaauacaacuugucaaacacccaagggugcuauaaacaccagccucccauuucagaauguacauccgaucacaauuggaaaauguccaaaauauguaaaaagcacaaaauugagacuggccacaggauugaggaaugucccgucuauucaaucucgaggccuauuuggggccauugccgguuucauugaagggggguggacagggaugguagauggaugguacgguuaccaucaucaaaaugagcaggggucaggauaugcagccgaccugaagagcacacagaaugccuuugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37214 - RNA, 1701 nt, Artificial Sequence; identical to SEQ ID NO: 37212
  hemagglutinin__InfluenzaA__AEC46557

SEQ ID NO: 37215 - RNA, 1701 nt, Artificial Sequence; identical to SEQ ID NO: 33197
  hemagglutinin__InfluenzaA__AEC53259

SEQ ID NO: 37216 - RNA, 1701 nt, Artificial Sequence
  hemagglutinin__InfluenzaA__AEC53269
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcuauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauacgaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37217 - RNA, 1701 nt, Artificial Sequence; identical to SEQ ID NO: 33903
  hemagglutinin__InfluenzaA__AEC53279

SEQ ID NO: 37218 - RNA, 1701 nt, Artificial Sequence; identical to SEQ ID NO: 33197
  hemagglutinin__InfluenzaA__AEC53289

SEQ ID NO: 37219 - RNA, 1701 nt, Artificial Sequence; identical to SEQ ID NO: 33197
  hemagglutinin__InfluenzaA__AEC53299

SEQ ID NO: 37220 - RNA, 1701 nt, Artificial Sequence; identical to SEQ ID NO: 33390
  hemagglutinin__InfluenzaA__AEC53327

SEQ ID NO: 37221 - RNA, 1701 nt, Artificial Sequence
  hemagglutinin__InfluenzaA__AEC53347
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaauagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37222 - RNA, 1701 nt, Artificial Sequence
  hemagglutinin__InfluenzaA__AEC53404
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguauaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37223 - RNA, 1701 nt, Artificial Sequence; identical to SEQ ID NO: 33197
  hemagglutinin__InfluenzaA__AEC53414

SEQ ID NO: 37224 - RNA, 1701 nt, Artificial Sequence
  hemagglutinin__InfluenzaA__AEE27177
augaagacaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaaaggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauucauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagaugggugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggauauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37225 - RNA, 1701 nt, Artificial Sequence; identical to SEQ ID NO: 36338
  hemagglutinin__InfluenzaA__AEE27187

SEQ ID NO: 37226 - RNA, 1701 nt, Artificial Sequence
  hemagglutinin__InfluenzaA__AEE27207
augaaggcaauacuaguaguucugcuauauacauuugcaaccgcaaaugcagacacauuauguauagguuaucaugcgaacaauucaacagacacuguagacacaguacuagaaaagaaugugacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuuuaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaagugaagaacuuauaugaaaagguaagaagccaguuaaaaaacaaugccaaggaaauuggaaacggaugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37227 - RNA, 1701 nt, Artificial Sequence
  hemagglutinin__InfluenzaA__AEG64752
augaaggcaauacuaguaguucugcuauauacauuugcaaccgcuaaugcagacacauuauguauagguuaucaugcgaacaauucaacagacacuguagacacaguacuagaaaagaacguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcaugcccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaagaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuucuuggacauuuggacuuacaaugccgaacuguugguucuauuggaaaaugaaagaacuuuagacuaccacgauucaaaugugaagaacuuauaugaaaagguaagaagacagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguauugguagucucccugggggcaaucaguuucuggaugugcuccaaugggucucuacaguguagaauaugcauuuaa

SEQ ID NO: 37228 - RNA, 1701 nt, Artificial Sequence
  hemagglutinin__InfluenzaA__AEG64762
augaaggcaagacuacugguccuguuaugugcacuugcagcuacagaugcagacacaauauguauaggcuaccaugcgaacaacucaaccgacacuguugacacacuacucgagaagaaugugacagugacacauucuguuaaccugcucgaagacagccacaacgggaaacuauguaaauuaaaaggaauagccccacuacaauuggggaaauguaacaucgccggauggcucuugggaaacccagaaugcgacucacugcuuccagcgagaucaugguccuacauuguagaaacaccaaacucugagaauggagcauguuauccaggagauuucaucgacuaugaggaacugagggagcaauugagcacaguaucaucauuagaaagauucgaaauauuucccaaggaaaguucauggcccaaccacaacacacucaaaggaguaacaguaucaugcucccaugggggaaaaagcaguuuuuacagaaauuugcuauggcugacgaaaacgggggacucauacccaaagcugaacaauuccuaugugaacaauaaagggaaagaaguccuuguacuaugggguguucaucacccgucuagcaguaaugagcaacagagucucuaucauaauguaaaugcuuaugucucuguagugucuucaaauuauaacaggagauucaccccggaaauagcugcaagacccaaaguaagagaucaaccugggaggaugaacuauuacuggaccuugcuagaacccggagacacaauauuauuugaggcaacugguaaucuaauagcaccaugguaugcuuucgcacugaguagaggguuuggguccggcaucaucaccucaaacgcgucaaugcaugaguguaacacgaagugucaaacaccccagggagcuauaaacagcagucucccuuuccagaauauacacccagucacaauaggagagugcccaaaauaugucaggaguaccaaauugaggaugguuacaggacuaagaaacaucccauccauucaauccagaggucuauuuggagccauugcugguuuuauugaggggggauggacuggaaugauagauggaugguaugguuaucaucaucagaaugaacagggaucaggcuaugcagcggaucaaaaaagcacacaaaaugccauuaacgggauuacaaacaaggugaacucuguuaucgagaaaaugaacacucaauucacagcuguggguaaagaauucaacaacuuagaaaaaaggauggaaaauuuaaauaaaaaaguugaugauggauuucuggacauuuggacauauaaugcagaauuguuaguucuacuggaaaaugaaaggacuuuggauuuccaugacuuaaaugugaaaaaucuguacgagaaaguaaaaagccaauuaaagaauaaugccaaagaaaucggaaauggguguuuugaguucuaccacaagugugacaaugaaugcauggaaaguguaagagaugggacuuaugauuauccaaaauauucagaagaaucaaaguugaacagggaaaagauagauggagugaaauuggaaucaauggggguguaucagauucuggcgaucuacucaacugucgccaguucacuggugcuuuuggucucccugggggcaaucaguuucuggauguguucuaaugggucuuugcagugcagaauaugcaucuaa

SEQ ID NO: 37229 - RNA, 1701 nt, Artificial Sequence
  hemagglutinin__InfluenzaA__AEG64784
augaaggcaauacuaguaguucugcuguauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccuucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagaucuuggcgaucuauucaacugucgccaguucauugguacugguagucucccugggggcaaucaguuucuggaugugcucuaaugggucucuacaguguagaauauguauuuaa

SEQ ID NO: 37230 - RNA, 1701 nt, Artificial Sequence
  hemagglutinin__InfluenzaA__AEG64834
augaagacuaucauugcuuugagcuacauucuaugucugguuuucgcccaaaaacuuccuggaaaugacaacagcacggcaacgcugugccuugggcaccaugcaguaccaaacggaacgauagugaaaacaaucacaaaugaccaaauugaaguuacuaaugcuacugagcugguucagaauuccucagcaggugaaauaugcgacaguccucaucagauccuugauggagaaaacugcacacuaauagaugcucuauugggagacccucagugugauggcuuccaaaauaagaaaugggaccuuuuuguugaacgaagcagagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaauggaaagcugaauagauuaaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37231 - RNA, 1701 nt, Artificial Sequence
  hemagglutinin__InfluenzaA__AEG64845
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucaucuggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37232 - RNA, 1701 nt, Artificial Sequence
  hemagglutinin__InfluenzaA__AEG64856
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuucguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggaggucuaauaaaaguuucuuuaguagauugaauugguugcaccaauugaaauacaaauacccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacagacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaguaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggugcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaauggcuguuucaaaauauaccacaaaugugacaaugccugcauagagucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 37233 - RNA, 1701 nt, Artificial Sequence; identical to SEQ ID NO: 30576
  hemagglutinin__InfluenzaA__AEG64867

SEQ ID NO: 37234 - RNA, 1701 nt, Artificial Sequence
  hemagglutinin__InfluenzaA__AEG64878
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaaugugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggaaggaaugguggacgguugguacgguuucaggcaucaaaauucugagggcauaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuucagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 37235 - RNA, 1701 nt, Artificial Sequence
  hemagglutinin__InfluenzaA__AEG64889
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuauuugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuuuaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaagacacuaaaauagaucucuggucguacaacgcggagcuucuuguugcccuggagaaccaacauacaauugaucuaacugacucagaaaugaacaaacuguuugaaaaaacaaggaagcaacugagggaaaaugcugaggauauggguaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 37236 - RNA, 1701 nt, Artificial Sequence
  hemagglutinin__InfluenzaA__AEG64911
augaagacuaucauugcuuugagcuacauucuaugucugguuuucgcucaaaaacuucccggaaaugacaacagcacggcaacgcugugccuugggcaccaugcagugccaaacggaacgauagugaaaacaaucacgaaugaccaaauugaaguuacuaaugcuacugagcugguacagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauuccgaaugcaucacuccaaauggaagcauucccaaugacaaaccauuucaaaauguaaacaggaucacauauggggccugucccagauauguuaagcaaaacacuuugaaauuggcaacagggaugcgaaauguaccagagaaacaaacuagaggcauauuuggcgcaaucgcgggcuucauagaaaaugguugggaaggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37237 - RNA, 1701 nt, Artificial Sequence
  hemagglutinin__InfluenzaA__AEG64922
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguacagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucucuagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauuccgaaugcaucacuccaaauggaagcauucccaaugacaaaccauuucaaaauguaaacaggaucacauauggggccugucccagauauguuaagcaaaacacuuugaaauuggcaacagggaugcgaaauguaccagagaaacaaacuagaggcauauuuggcgcaaucgcgggcuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugauucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37238 - RNA, 1701 nt, Artificial Sequence
  hemagglutinin__InfluenzaA__AEG64933
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguacagaguuccucaacagguggaauaugcgauaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauuccgaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37239 - RNA, 1701 nt, Artificial Sequence
  hemagglutinin__InfluenzaA__AEG64944
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguacagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuagaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauauuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccguuuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37240 - RNA, 1701 nt, Artificial Sequence
  hemagglutinin__InfluenzaA__AEG64955
augaagacuaucauugcuuugagcuacauucuaugucugguuuucgcucaaaaacuucccggaaaugacaacagcacggcaacguugugccuugggcaccaugcaguaccaaacggaacgauagugaaaacaaucacgaaugaccaaauugaaguuacuaaugcuacugaguugguacagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccagaguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauuccgaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaagauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37241 - RNA, 1701 nt, Artificial Sequence
  hemagglutinin__InfluenzaA__AEG64966
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugaguugguacagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccagaguaagggaugucuccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauuccgaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucagacaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37242 - RNA, 1701 nt, Artificial Sequence
  hemagglutinin__InfluenzaA__AEG64977
augaagacuaucauugcuuugagcuacauucuaugucugguuuucgcucaaaaacuucccgaaaaugacaacagcacggcaacgcugugccuugggcaccaugcaguaccaaacggaacgauagugaaaacaaucacgaaugaccaaauugaaguuacuaaugcuacugagcugguacagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccuaauaucggaucuagacccaggguaagggaugucucuagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauugacaaaugcaauuccgaaugcaucacuccaaauggaagcauucccaaugacaaaccauuucaaaauguaaacaggaucacauauggggccugucccagauauguuaagcaaaacacuuugaaauuggcaacagggaugcgaaauguaccagagaaacaaacuagaggcauauuuggcgcaaucgcgggcuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37243 - RNA, 1701 nt, Artificial Sequence
  hemagglutinin__InfluenzaA__AEG64988
augaagacuaucauugcuuugagcuacauucuaugucugguuuucgcccaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaugccucaucagauccuugauggagaaaacugcacacuaauagaugcucuauugggagacccccagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuuuuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguuguuuuguugggguucaucaugugggccugccaaaaaggcaacauuaggugcaacauuugcauuuga

SEQ ID NO: 37244 - RNA, 1701 nt, Artificial Sequence
  hemagglutinin__InfluenzaA__AEG64999
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaauuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugucucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaagaccucgagaaauauguugaggacacuaaaauagaucucuggucauacaacgcagagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37245 - RNA, 1701 nt, Artificial Sequence
  hemagglutinin__InfluenzaA__AEG65010
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuauugaacgcagcaaagccuacagcaacuguuacccuuaugaugugccggauuaugccucccuuaggucacuaguugccucauccggcacacuggaauuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcuucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaagauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauugaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacaucugcauuuga

SEQ ID NO: 37246 - RNA, 1701 nt, Artificial Sequence
  hemagglutinin__InfluenzaA__AEG65021
augaagacuaucauugcuuuaagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugucucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacacugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaucaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37247 - RNA, 1701 nt, Artificial Sequence
  hemagglutinin__InfluenzaA__AEG65032
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacucuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauaaguugaucgggaaaaccaacgagaaauuccaucagauugaaaaggaauucucagaaguagaagggagaauucaggaccucgagaaauauguugaggacacuaaaauagaucucuggucauacaacgcggagcuucuuguugcccuggagaaccaacauacaauugaucuaacugacucggaaaugaacaaacuguuugaaagaacaaagaagcaacugagggaaaaugcugaggauaugggcaaugguuguuucaaaauauaccacaaaugugacaaugccugcauaggaucaauaagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37248 - RNA, 1701 nt, Artificial Sequence
  hemagglutinin__InfluenzaA__AEG65043
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugaacugguucagaguuccucaacagguggaauaugcgacaguccucaucagauccuugauggagaaaacugcacacuaauagaugcucuauugggagacccucagugugauggcuuccaaaauaagaagugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaagcuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugaacugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37249 - RNA, 1701 nt, Artificial Sequence
  hemagglutinin__InfluenzaA__AEG65054
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacauuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37250 - RNA, 1701 nt, Artificial Sequence
  hemagglutinin__InfluenzaA__AEG65065
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagacugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagaccuagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaaugguagcauucccaaugacaaaccauuucaaaauguaaacagaaucacauauggggccugucccagauauguuaagcaaaacacucugaaauuggcaacagggaugagaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaagggcguugagcugaagucaggauacaaagauuggguccuauggauuuccuuugccauaucauguuuuuugcuuuguguuguuuuguugggguucaucaugugggccugccaaaaaggcaacauuaggugcaacauuugcauuuga

SEQ ID NO: 37251 - RNA, 1701 nt, Artificial Sequence
  hemagglutinin__InfluenzaA__AEG65076
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaagauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaaugucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaauguaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaacaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacaccaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37252 - RNA, 1701 nt, Artificial Sequence
  hemagglutinin__InfluenzaA__AEG65087
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacgaacaaugaccaaaucuuccuguaugcucaagcaucaggaagaaucacaguaucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucagaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcagagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37253 - RNA, 1701 nt, Artificial Sequence
  hemagglutinin__InfluenzaA__AEG65098
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugaugacuuccaaaauaagaaaugggaccuuuuuguugaacgcagcaaagccuacagcaacuguuacccuuaugauguaccggauuaugccucccuuaggucacuaguugccucauccggcacacuggaguuuaacaaugaaagcuucaauuggacuggagucacucaaaauggaacaagcucugcuugcaaaaggagauccaauaacaguuucuuuaguagacugaauugguugacccacucaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagaccuagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacagaaucacauauggggccugucccagauauguuaagcaaaacacucugaaauuggcaacagggaugagaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaaucugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucugacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguguacagagaugaagcauuaaacaaccgguuccagaucaaaggcguugagcugaagucaggauacaaagauuggauccuauggauuuccuuugccauaucauguuuuuugcuuuguguuguuuuguugggguucaucaugugggccugccaaaaaggcaacauuaggugcaacauuugcauuuga

SEQ ID NO: 37254 - RNA, 1701 nt, Artificial Sequence
  hemagglutinin__InfluenzaA__AEG65109
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacagcccucaucagauccuugauggagaaaacugcaaacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaaucaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaggggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37255 - RNA, 1701 nt, Artificial Sequence
  hemagglutinin__InfluenzaA__AEG65120
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagacugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagaccuagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacagaaucgcauauggggccugucccagauauguuaagcaaaacacucugaaauuggcaacagggaugagaaauguaccagagaaacaaacuagaggcauauuuggcgcaaucgcagguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguuguuuuguugggguucaucaugugggccugccaaaaaggcaacauuaggugcaacauuugcauuuga

SEQ ID NO: 37256 - RNA, 1701 nt, Artificial Sequence
  hemagglutinin__InfluenzaA__AEG65131
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugauguaccggauuaugccucccuuaggucacuaguugccucauccggcacacuggaguuuaacaaugaaagcuucaauuggacuggagucacucaaaauggaacaagcucugcuugcaaaaggagauccaauaacaguuucuuuaguagacugaauugguugacccacucaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagaccuagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacagaaucacauauggggccugucccagauauguuaagcaaaacacucugaaauuggcaacagggaugagaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguguacagagaugaagcauuaaacaaccgguuccagaucaagggcguugagcugaagucaggauacaaagauuggauccuauggauuuccuuugccauaucauguuuuuugcuuuguguuguuuuguugggguucaucaugugggccugccaaaaaggcaacauuaggugcaacauuugcauuuga

SEQ ID NO: 37257 - RNA, 1701 nt, Artificial Sequence
  hemagglutinin__InfluenzaA__AEG65142
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuacugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcucugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauaugggcccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 37258 - RNA, 1701 nt, Artificial Sequence; identical to SEQ ID NO: 31947
  hemagglutinin__InfluenzaA__AEG65153

SEQ ID NO: 37259 - RNA, 1701 nt, Artificial Sequence
  hemagglutinin__InfluenzaA__AEG65164
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucugauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauaugggcccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaaggaagaauucaggaccucgagaaauauguugaggacacuaaaauagaucucuggucguacaaugcggaguuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 37260 - RNA, 1701 nt, Artificial Sequence
  hemagglutinin__InfluenzaA__AEG65175
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucagaauggaacaagcucugcuugcgaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaaaugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcgacauuugcauuuga

SEQ ID NO: 37261 - RNA, 1701 nt, Artificial Sequence
  hemagglutinin__InfluenzaA__AEG65186
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaacgaaaaauaugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauaucccaagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggagccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37262 - RNA, 1701 nt, Artificial Sequence
  hemagglutinin__InfluenzaA__AEG65197
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccccaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcuccgcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcuucaggaagaaucacagucucuaccaaaagaagccaacaaacuguaaucccgaauaucggaucuagacccaggguaagggauauccccagcagaauaagcaucuauuggacaauaguaaaaccgggagacauaauuuugauuaacagcacagggaaucuaauugcuccucgggguuacuucaaaauacgaagugggaaaagcucaauaaugagaucagauacacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaacagguugaucgggaaaaccaacgagaaauuccaucagauugaaaaagaauucucagaaguagaagggagaauucaggaccuagagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37263 - RNA, 1701 nt, Artificial Sequence; identical to SEQ ID NO: 31139
  hemagglutinin__InfluenzaA__AEG65208

SEQ ID NO: 37264 - RNA, 1701 nt, Artificial Sequence
  hemagglutinin__InfluenzaA__AEG65219
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaaaaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauguccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacccugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggaacaggacaagcagcagaucucaaaagcacucaagcagcaaucaaccaaaucaaugggaagcugaauagguugaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaagugcaacauuugcauuuga

SEQ ID NO: 37265 - RNA, 1701 nt, Artificial Sequence
  hemagglutinin__InfluenzaA__AEG65230
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaaaaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauguccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacccugaaauuggcaacagggaugcgaaauguaccagagaaacaaacuagaggcauauuuggcgcaaucgcggguuucauagaaaaugguugggagggaaugguggacgguugguaugguuucaggcaucaaaauucugagggaacaggacaagcagcagaucucaaaagcacucaagcagcaaucaaccaaaucaaugggaagcugaauagguugaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37266 - RNA, 1701 nt, Artificial Sequence; identical to SEQ ID NO: 32299
  hemagglutinin__InfluenzaA__AEG65252

SEQ ID NO: 37267 - RNA, 1701 nt, Artificial Sequence; identical to SEQ ID NO: 31024
  hemagglutinin__InfluenzaA__AEG65263

SEQ ID NO: 37268 - RNA, 1701 nt, Artificial Sequence; identical to SEQ ID NO: 31024
  hemagglutinin__InfluenzaA__AEG65274

SEQ ID NO: 37269 - RNA, 1701 nt, Artificial Sequence; identical to SEQ ID NO: 31024
  hemagglutinin__InfluenzaA__AEG65285

SEQ ID NO: 37270 - RNA, 1701 nt, Artificial Sequence
  hemagglutinin__InfluenzaA__AEG65296
augaagacugucauugcuuugagcuacauucuaugucugguuuucgcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggaucaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauauaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37271 - RNA, 1701 nt, Artificial Sequence; identical to SEQ ID NO: 32299
  hemagglutinin__InfluenzaA__AEG65307

SEQ ID NO: 37272 - RNA, 1701 nt, Artificial Sequence
  hemagglutinin__InfluenzaA__AEG65318
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaaaaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauguccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaggcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggaacaggacaagcagcagaucucaaaagcacucaagcagcaaucaaccaaaucaaugggaagcugaauagguugaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuugcugggguucaucaugugggccugccaaaaaggcaacauuaggugcaacauuugcauuuga

SEQ ID NO: 37273 - RNA, 1701 nt, Artificial Sequence; identical to SEQ ID NO: 37265
  hemagglutinin__InfluenzaA__AEG65329

SEQ ID NO: 37274 - RNA, 1701 nt, Artificial Sequence
  hemagglutinin__InfluenzaA__AEG65340
augaagacuaucauugcuuugagcuacauucuaugucugguuuucgcucaaaagcuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucagaauggaacaagcucugcuugcgaaaggagaucuaacaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagcaggauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaaugggagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagagucaaucagaaauggaacuuaugaccaugauguauacagagaugaagcauugaacaaccgguuccagaucaaagguguugagcugaaaucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37275 - RNA, 1701 nt, Artificial Sequence
  hemagglutinin__InfluenzaA__AEG65351
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaaaaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauguccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacccugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggaacaggacaagcagcagaucucaaaagcacucaagcagcaaucaaccaaaucaaugggaagcugaauagguugaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37276 - RNA, 1701 nt, Artificial Sequence; identical to SEQ ID NO: 37265
  hemagglutinin__InfluenzaA__AEG65362

SEQ ID NO: 37277 - RNA, 1701 nt, Artificial Sequence; identical to SEQ ID NO: 37274
  hemagglutinin__InfluenzaA__AEG65373

SEQ ID NO: 37278 - RNA, 1701 nt, Artificial Sequence; identical to SEQ ID NO: 31024
  hemagglutinin__InfluenzaA__AEG65384

SEQ ID NO: 37279 - RNA, 1701 nt, Artificial Sequence; identical to SEQ ID NO: 31024
  hemagglutinin__InfluenzaA__AEG65406

SEQ ID NO: 37280 - RNA, 1701 nt, Artificial Sequence; identical to SEQ ID NO: 31024
  hemagglutinin__InfluenzaA__AEG65417

SEQ ID NO: 37281 - RNA, 1701 nt, Artificial Sequence; identical to SEQ ID NO: 31024
  hemagglutinin__InfluenzaA__AEG65428

SEQ ID NO: 37282 - RNA, 1701 nt, Artificial Sequence
  hemagglutinin__InfluenzaA__AEG65439
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacagcccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggauaacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaguaggacaagcagcagaucucaaaagcacgcaagcagcaaucaaucaaaucaaugggaagcugaauagguugaucgggaagaccaacgagaaauuccaucagauugaaaaagaauucucagaaguagaagggagaauucaagaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37283 - RNA, 1701 nt, Artificial Sequence
  hemagglutinin__InfluenzaA__AEG65450
augaagacuaucauugcuuggagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauagcaguuucuuuaguagauugaauugguugacccacuuaaaauucaaauacccagcauugaacgugacuaugccaaacaaugaagaauuugacaaauuguacauuugggggguucaccacccggguacauacaaugaccaaaucagccuauaugcucaagcaucaggaagaaucacagucucuaccaaaagaagccaacaaacuguaaucccgaauaucgggucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37284 - RNA, 1701 nt, Artificial Sequence; identical to SEQ ID NO: 37283
  hemagglutinin__InfluenzaA__AEG65461

SEQ ID NO: 37285 - RNA, 1701 nt, Artificial Sequence
  hemagglutinin__InfluenzaA__AEG65472
augaagacuaucauugcuuggagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauagcaguuucuuuaguagauugaauugguugacccacuuaaaauucaaauacccagcauugaacgugacuaugccaaacaaugaagaauuugacaaauuguacauuugggggguucaccacccggguacauacaaugaccaaaucagccuauaugcucaagcaucaggaagaaucacagucucuaccaaaagaagccaacaaacuguaaucccgaauaucgggucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaauaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggcuugccaaaaaggcaacauuaggugcaacauuugcauuuga

SEQ ID NO: 37286 - RNA, 1701 nt, Artificial Sequence; identical to SEQ ID NO: 37283
  hemagglutinin__InfluenzaA__AEG65483

SEQ ID NO: 37287 - RNA, 1701 nt, Artificial Sequence; identical to SEQ ID NO: 37283
  hemagglutinin__InfluenzaA__AEG65494

SEQ ID NO: 37288 - RNA, 1701 nt, Artificial Sequence; identical to SEQ ID NO: 37283
  hemagglutinin__InfluenzaA__AEG65505

SEQ ID NO: 37289 - RNA, 1701 nt, Artificial Sequence
  hemagglutinin__InfluenzaA__AEG65516
augaagacuaucauugcuuggagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauagcaguuucuuuaguagauugaauugguugacccacuuaaaauucaaauacccagcauugaacgugacuaugccaaacaaugaagaauuugacaaauuguacauuugggggguucaccacccggguacauacaaugaccaaaucagccuauaugcucaagcaucaggaagaaucacagucucuaccaaaagaagccaacaaacuguaaucccgaauaucgggucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggugcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37290 - RNA, 1701 nt, Artificial Sequence; identical to SEQ ID NO: 37283
  hemagglutinin__InfluenzaA__AEG65527

SEQ ID NO: 37291 - RNA, 1701 nt, Artificial Sequence; identical to SEQ ID NO: 37283
  hemagglutinin__InfluenzaA__AEG65538

SEQ ID NO: 37292 - RNA, 1701 nt, Artificial Sequence
  hemagglutinin__InfluenzaA__AEG65560
augaagacuaucauugcuuugagcuacauucuaugucugguuuucgcucaaaaacuucccggaaaugacaacagcacagcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauagcaguuucuuuaguagauugaauugguugacccacuuaaaauucaaauacccagcauugaacgugacuaugccaaacaaugaagaauuugacaaauuguacauuugggggguucaccacccggguacauacaaugaccaaaucagccuauaugcucaagcaucaggaagaaucacagucucuaccaaaagaagccaacaaacuguaaucccgaauaucgggucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugaaaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucaugcuuuuugcuuuguguugcuuuguugggguucaucaugugggccugccaaaaaggcaacauuaggugcaacauuugcauuuga

SEQ ID NO: 37293 - RNA, 1701 nt, Artificial Sequence
  hemagglutinin__InfluenzaA__AEG65571
augaagacuaucauugcuuugagcuacauucuaugucugguuuucgcucaaaaacuucccggaaaugacaacagcacagcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauagcaguuucuuuaguagauugaauugguugacccacuuaaaauucaaauacccagcauugaacgugacuaugccaaacaaugaagaauuugacaaauuguacauuugggggguucaccacccggguacauacaaugaccaaaucagccuauaugcucaagcaucaggaagaaucacagucucuaccaaaagaagccaacaaacuguaaucccgaauaucgggucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugaaaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37294 - RNA, 1701 nt, Artificial Sequence; identical to SEQ ID NO: 37293
  hemagglutinin__InfluenzaA__AEG65582

SEQ ID NO: 37295 - RNA, 1701 nt, Artificial Sequence; identical to SEQ ID NO: 37293
  hemagglutinin__InfluenzaA__AEG65593

SEQ ID NO: 37296 - RNA, 1701 nt, Artificial Sequence
  hemagglutinin__InfluenzaA__AEG65604
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugccacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaagaauuugacaaauuguacauuugggggguucaccacccggguacggacaaugaccaaaucagccuauaugcucaagcaucaggaaaaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauccaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37297 - RNA, 1701 nt, Artificial Sequence
  hemagglutinin__InfluenzaA__AEG65626
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggaaaucuaauaacaguuucuuuaguagauugaauugguugacccacuuaaaauucaaauacccagcauugaacgugacuaugccaaacaauaaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacaugcuuuugauuaacagcacagggaaucuaauugcuccucgggguuacuucaaaauacgaagugggaaaaguucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaacaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37298 - RNA, 1701 nt, Artificial Sequence
  hemagglutinin__InfluenzaA__AEG65637
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaucuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggaaaucuaauaacaguuucuuuaguagauugaauugguugacccacuuaaaauucaaauacccagcauugaacgugacuaugccaaacaauaaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacaugcuuuugauuaacagcacagggaaucuaauugcuccucgggguuacuucaaaauacgaagugggagaaguucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaacaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37299 - RNA, 1701 nt, Artificial Sequence
  hemagglutinin__InfluenzaA__AEG65648
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucagaauggaacaagcucugcuugcgaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggauguauccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagccuuaaauaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcgacauuugcauuuga

SEQ ID NO: 37300 - RNA, 1701 nt, Artificial Sequence
  hemagglutinin__InfluenzaA__AEG65659
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaaaaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauguccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcauaacuccaaauggaagcauucccaaugacaaaccauuucaaaauguaaacaggaucacauauggggccugucccagauauguuaagcaaaacacccugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggaacaggacaagcagcagaucucaaaagcacucaagcagcaaucaaccaaaucaaugggaagcugaauagguugaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37301 - RNA, 1701 nt, Artificial Sequence; identical to SEQ ID NO: 37265
  hemagglutinin__InfluenzaA__AEG65670

SEQ ID NO: 37302 - RNA, 1701 nt, Artificial Sequence; identical to SEQ ID NO: 37275
  hemagglutinin__InfluenzaA__AEG65681

SEQ ID NO: 37303 - RNA, 1701 nt, Artificial Sequence; identical to SEQ ID NO: 37274
  hemagglutinin__InfluenzaA__AEG65692

SEQ ID NO: 37304 - RNA, 1701 nt, Artificial Sequence
  hemagglutinin__InfluenzaA__AEG65703
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacucuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaggaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37305 - RNA, 1701 nt, Artificial Sequence
  hemagglutinin__InfluenzaA__AEG65747
augaagacuaucauugcuuugagcuacauucuaugucugguuuucgcucaaaaacuucccggaaaugacaacagcacggcaacgcugugccuugggcaccauacaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagauccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaacaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguguacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37306 - RNA, 1701 nt, Artificial Sequence
  hemagglutinin__InfluenzaA__AEG65758
augaagacuaucauugcuuugagcuacauucuaugucugguuuccgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37307 - RNA, 1701 nt, Artificial Sequence
  hemagglutinin__InfluenzaA__AEG65769
augaagacuaucauugcuuugagcuacauucuaugucugguuuuugcucaaaaacuucccggaaaugacaacagcacggcaacgcugugccuugggcaccaugcaguaccaaacggaacgauagugaaaacaaucacgaaugaccaaauugaagucacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugacgugccggauuaugccucccuuagaucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaacuguacauuugggggguucaccacccggguacggacaaugaccaaaucagccuauaugcucaagcaucaggaagaaucacagucucuaccaaaagaagccaacaaacuguaaucccgaguaucggaucuagacccaggauaagggauguccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggaacaggacaagcagcagaucucaaaagcacucaagcagcaaucaaccaaaucaaugggaagcugaauagguugaucgggaaaacaaacgagaaauuccaucagauugaaaaagaauucucagaaguagaagggagaauucaggaccucgagaaauauguugaggacacuaaaauagaucucuggucauacaacgcggagcuucuuguggcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugaguugaagucaggauacaaagauuggauccuauggauuuccuuugccauaucauguuuuuugcuuuguguugcuuuguugggguucaucaugugggccugccaaaaaggcaacauuagaugcaacauuugcauuuga

SEQ ID NO: 37308 - RNA, 1701 nt, Artificial Sequence
  hemagglutinin__InfluenzaA__AEG65780
augaagacuaucauugcuuugagcuacauucuaugucugguuuucgcccaaaaacuuccuggaaaugacaacagcacggcaacgcugugccuugggcaccaugcagugccaaacggaacgauagugaaaacaaucacgaaugacaaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccgcauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaauuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37309 - RNA, 1701 nt, Artificial Sequence
  hemagglutinin__InfluenzaA__AEG65813
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaaacugaauagauugaucgggaaaaccaacgagaaauuccaucagauugaaaaagaauucucagaagucgaagggagaauucaggaccuugagaaauauguugaggacacuaaaacagaucucuggucauacaacgcggagcuucuuguugcccuggagaaccaacacacaauugaucuaacugacucagaaaugaacaaauuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37310 - RNA, 1701 nt, Artificial Sequence
  hemagglutinin__InfluenzaA__AEG79801
augaaggcaauacuaguaguuuugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagaugcauauguuuuuguggggacaucaagauacagcaagaaguucaagccggaaauagcaauaagacccaaagugagggaucgagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccaugauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguaucuaa

SEQ ID NO: 37311 - RNA, 1701 nt, Artificial Sequence
  hemagglutinin__InfluenzaA__AEG79807
augaaggcaauacuaguaguucuacuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaagaaaauucauacccaaagcucagcaaauccuacauuaaugauaaagggaaagaaguccucgugcuauggggcauucaccauccaucuacuacugcugaccaacaaaguaucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauuugaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggacugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuacuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 37312 - RNA, 1701 nt, Artificial Sequence
  hemagglutinin__InfluenzaA__AEG79835
augaaggcaauacuaguaguucugcuauauacauuugcaaccgcaaaugcagacacauuauguauagguuaccaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugaaauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaaguaucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaacgagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuucuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 37313 - RNA, 1701 nt, Artificial Sequence
  hemagglutinin__InfluenzaA__AEH59363
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacugagagggguagccccauugcauuuggguaaauguaacauugcuggcuggauccugggaaauccagagugugaaucacucuccacagcaagcucaugguccuacaucguggaaacaucuaguucagacaauggaacgugcuacccaggagauuucaucaauuaugaggagcuaagagagcaauugagcucagugucaucauuugaaagguuugagauauuccccaagacaaguucauggcccaaucaugacucgaacaaagguguaacggcagcauguccucaagcuggagcaaaaagcuucuacaaaaauuuaauauggcuaguuaaaaaaggaaauucauacccaaagcucagcaaauccuacauuaacgauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaguaagacccaaagugagggaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaaugucccaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugcgcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaaaaacuuauaugaaaagguaagaagccaguuaaaaaacaaugccaaggaaauuggaaacggcugcuuugaauuuuaccacaaaugcgacaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37314 - RNA, 1701 nt, Artificial Sequence
  hemagglutinin__InfluenzaA__AEH59367
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauaccccaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacugggcacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacaaaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37315 - RNA, 1701 nt, Artificial Sequence
  hemagglutinin__InfluenzaA__AEH59369
augaaggcaauacuaguaguucugcuauauacauuugcaaccgcaaaugcagacacauuauguauagguuaccaugcgaacaauucaacagacacuguagacacaguacuagaaaagaauguaacaguaacacacucugucaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucauugauuaugaggagcuaagagagcaauugagcucagugucaucauuugaaagauuugagauauuccccaaggcaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 37316 - RNA, 1701 nt, Artificial Sequence; identical to SEQ ID NO: 37313
  hemagglutinin__InfluenzaA__AEH59371

SEQ ID NO: 37317 - RNA, 1701 nt, Artificial Sequence
  hemagglutinin__InfluenzaA__AEH59373
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagagguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccaugauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucgccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaagaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 37318 - RNA, 1701 nt, Artificial Sequence
  hemagglutinin__InfluenzaA__AEH59375
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacugagagggguagccccauugcauuuggguaaauguaacauugcuggcuggauccugggaaauccagagugugaaucacucuccacagcaagcucaugguccuacaucguggaaacaucuaguucagacaauggaacgugcuacccaggagauuucaucaauuaugaggagcuaagagagcaauugagcucagugucaucauuugaaagguuugagauauuccccaagacaaguucauggcccaaucaugacucgaacaaagguguaacggcagcauguccucaagcuggagcaaaaagcuucuacaaaaauuuaauauggcuaguuaaaaaaggaaauucauacccaaagcucagcaaauccuacauuaacgauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaguaagacccaaagugagggaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaaugucccaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugcgcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagaaaauuuaaauaaaaaaguugaugaugguuuccuggacauuuggacuuacaaugccgaacuguugguucuauuggaaaaugaaagaacuuuggacuaccacgauucaaaugugaaaaacuuauaugaaaagguaagaagccaguuaaaaaacaaugccaaggaaauuggaaacggcugcuuugaauuuuaccacaaaugcgacaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37319 - RNA, 1701 nt, Artificial Sequence
  hemagglutinin__InfluenzaA__AEH59379
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagggagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaacuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 37320 - RNA, 1701 nt, Artificial Sequence; identical to SEQ ID NO: 37318
  hemagglutinin__InfluenzaA__AEH59381

SEQ ID NO: 37321 - RNA, 1701 nt, Artificial Sequence
  hemagglutinin__InfluenzaA__AEH59383
augaaggcaauacuaguaguucugcuauauacauuugcaaccgcaaaugcagacacauuauguauagguuaccaugcgaacaauucaacagacacuguagacacaguacuagaaaagaauguaacaguaacacacucugucaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucauugauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcauauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaaguaagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 37322 - RNA, 1701 nt, Artificial Sequence
  hemagglutinin__InfluenzaA__AEH59385
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaagcuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaagggaauucauacccaaagcucagcaaauccuacauuaaugauaaagggaaagaaguccucgugcuauggggcauucaccauccaucuacuacugcugaccaacaaagucucuaucagaaugcagaugcauauauuuuuguggggacaucaagauacagcaagaaguucaagccggaaauagcaauaagacccaaagugagagaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaaaaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauuaguacugguagucucccugggggcaaucaguuucuggaugugcucuaaugggucucuacaguguagaauauguauuuaa

SEQ ID NO: 37323 - RNA, 1701 nt, Artificial Sequence; identical to SEQ ID NO: 37318
  hemagglutinin__InfluenzaA__AEH59387

SEQ ID NO: 37324 - RNA, 1701 nt, Artificial Sequence
  hemagglutinin__InfluenzaA__AEH59393
augaaggcaauacuaguaguuauacuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaaaacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccuugugcuauggggcauucaccauccgucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgauuacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 37325 - RNA, 1701 nt, Artificial Sequence
  hemagglutinin__InfluenzaA__AEH59397
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacugagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaagagcuaagagagcaauugagcucagugucaucauuugaaagguuugagauauuccccaagacaaguucauggcccagucaugacucgaacaaagguguaacggcagcauguccucaugcuggagcaaaaagcuucuacaaaaauuuaauauggcuaguuaaaaaaggaaauucauacccaaagcucagcaaauccuacauuaacgauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaguaagacccaaagugagagaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaaaagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaaaaacuuauaugaaaagguaagaagccaguuaaaaaacaaugccaaggaaauugaaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37326 - RNA, 1701 nt, Artificial Sequence
  hemagglutinin__InfluenzaA__AEH59399
augaaggcaauacuaguaguucugcuauauacauuugcaaccgcaaaugcagacacauuauguauagguuaccaugcgaacaauucaacagacacuguagacacaguacuagaaaagaauguaacaguaacacacucugucaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucauugauuaugaggagcuaagagagcaauugagcucagugucaucauuugaaagauuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacaauaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauugggaaauguccaaaauauguaaaaagcaccaaauugagacuggccacaggauugaggaaugucccgucuauucaaucuagaggccuauuuggggccauugccggcuucauugaagggggguggacagggaugguagauggaugguacgguuaucaccaucaaaaugagcaagggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 37327 - RNA, 1701 nt, Artificial Sequence
  hemagglutinin__InfluenzaA__AEH59403
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagcgccgggagacaaaauaacauucgaagcaacuggaaaucuagugguaccgagauaugcauucgcgauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucaguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccaugauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 37328 - RNA, 1701 nt, Artificial Sequence
  hemagglutinin__InfluenzaA__AEH59407
augaaagcaauacuaguaguuaugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaaaacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugugauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 37329 - RNA, 1701 nt, Artificial Sequence
  hemagglutinin__InfluenzaA__AEH59409
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaaaacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaaaaacuuauaugaaaagguaagaaaccaguuaaaaaacaaugccaaggaaauuggaaauggcugcuuugaauuuuaccacaaaugugauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacuguugccaguucauugguacugguagucucccugggggcaaucaguuuuuggaugugcucuaaugggucucuacaguguagaauauguauuuaa

SEQ ID NO: 37330 - RNA, 1701 nt, Artificial Sequence
  hemagglutinin__InfluenzaA__AEH59411
augaaggcaauacuaguaguucugcuauauacauuugcaaccgcaaaugcagacacauuauguauagguuaccaugcgaacaauucaacagacacuguagacacaguacuagaaaagaauguaacaguaacacacucugucaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucauugauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggacagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguugaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 37331 - RNA, 1701 nt, Artificial Sequence
  hemagglutinin__InfluenzaA__AEH59413
augaaggcaauacuaguaguucugcuauauacauuugcaaucgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacugagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggaacuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaacgauaaagggaaagaaguccucgugcuguggggaauucaccauccaucuacuagugcugaccaacaaagucucuaucagaaugcagaugcauauguuuuuguggggacaucaaaauacagcaagaaauucaagccggaaauagcaguaagacccaaagugagggaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaaaaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37332 - RNA, 1701 nt, Artificial Sequence
  hemagglutinin__InfluenzaA__AEH59585
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgacuugaagagcacacagaaugccauugacgagauuacuaacaaaguaaauucuguuauugaaaagaugaauacacaguucacaguaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37333 - RNA, 1701 nt, Artificial Sequence
  hemagglutinin__InfluenzaA__AEH59587
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugaaucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccguuuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacaguaguagguaaagaguucaacccccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgacaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37334 - RNA, 1701 nt, Artificial Sequence
  hemagglutinin__InfluenzaA__AEH59589
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgacaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37335 - RNA, 1701 nt, Artificial Sequence
  hemagglutinin__InfluenzaA__AEH59591
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacaguaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgacaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37336 - RNA, 1701 nt, Artificial Sequence
  hemagglutinin__InfluenzaA__AEH59593
augaaggcaauacuaguaguucugcuauauacauuugcaacugcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugaaucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaaguaucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgacaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37337 - RNA, 1701 nt, Artificial Sequence; identical to SEQ ID NO: 33971
  hemagglutinin__InfluenzaA__AEH59595

SEQ ID NO: 37338 - RNA, 1701 nt, Artificial Sequence
  hemagglutinin__InfluenzaA__AEH59597
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacuuuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacuauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggcuaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37339 - RNA, 1701 nt, Artificial Sequence
  hemagglutinin__InfluenzaA__AEH59599
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucugucauugaaaagaugaauacacaguucacaguaguagguaaagaguucaaccaccuggaaaaaagaauagagaauuuaaauaaaaaaguugaugaugguuuccuggacauuuggacuuacaaugccgaacuguugguucuauuggaaaaugaaagaacauuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37340 - RNA, 1701 nt, Artificial Sequence
  hemagglutinin__InfluenzaA__AEH59601
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaacuguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacgaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggacugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacaguaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgacaacacgugcauggaaagugucaaaaaugggacuuaugacuacccaaaauacucagaggaagcaaaauuaaacagagaagaaauagaugggguaaagcuggaaucaacaaggaucuaccagauuuuggcgaucuacucaacugucgccaguucauugguacugguagucucccugggggcaaucaguuucuggaugugcucuaaugggucuuuacaguguagaauauguauuuaa

SEQ ID NO: 37341 - RNA, 1701 nt, Artificial Sequence; identical to SEQ ID NO: 34080
  hemagglutinin__InfluenzaA__AEH59604

SEQ ID NO: 37342 - RNA, 1701 nt, Artificial Sequence
  hemagglutinin__InfluenzaA__AEH59614
augaaggcaauacuaguaguucugcuauauacauuugcaacugcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37343 - RNA, 1701 nt, Artificial Sequence
  hemagglutinin__InfluenzaA__AEH59624
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaaguuucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaauacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37344 - RNA, 1698 nt, Artificial Sequence
  hemagglutinin__InfluenzaA__AEH77259
augaaaguaaaacuacugguccuguuaugcacauucacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcgucgccggguggaucuuaggaaacccagaaugcgaauuauugauuuccaaggagucaugguccuacauuguagaaaaaccaaauccugagaauggaacauguuacccagggcauuucgcugacuaugaggaacugagggagcaauugaguucaguaucuucauuugagagguucgaaauguuccccaaagaaagcucauggcccaaccacaccguaaccggagugucagcaucaugcucccauaauggggaaagcaguuuuuacagaaauuugcuauggcugacggagaagaaugguuuguacccgaaccugagcaaguccuaugcaaacaacaaagaaaaagaaguccuuguacuaugggguguucaucacccgccaagcauaagugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaacaaaaaaguugaugauggguuuauagacauuuggacauauaaugcagaacuguugguucuacuggaaaaugaaaggacuuuggauuuccaugacuccaaugugaagaaucuguaugagaaaguaaaaaaccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguuuuuuuggucucccugggggcaaucagcuucuggauguguuccaaugggucuuugcaguguagaauaugcaucuaa

SEQ ID NO: 37345 - RNA, 1701 nt, Artificial Sequence; identical to SEQ ID NO: 33197
  hemagglutinin__InfluenzaA__AEH77270

SEQ ID NO: 37346 - RNA, 1701 nt, Artificial Sequence
  hemagglutinin__InfluenzaA__AEH77279
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguacagaguuccucaacagguggaauaugcgacagcccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagauccaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagaccuaggguaagggaugucucuagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauuccgaaugcaucacuccaaauggaagcauucccaaugacaaaccauuucaaaauguaaacaggaucacauauggggccugucccagauauguuaagcaaaacacuuugaaauuggcaacagggaugcgaaauguaccagagaaacaaacuagaggcauauuuggcgcaaucgcgggcuucauagaaaaugguugggagggaaugguggacgguugguacgguuucaggcaucaaaauuccgagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37347 - RNA, 1701 nt, Artificial Sequence; identical to SEQ ID NO: 34679
  hemagglutinin__InfluenzaA__AEI29215

SEQ ID NO: 37348 - RNA, 1701 nt, Artificial Sequence; identical to SEQ ID NO: 33173
  hemagglutinin__InfluenzaA__AEI29225

SEQ ID NO: 37349 - RNA, 1701 nt, Artificial Sequence
  hemagglutinin__InfluenzaA__AEI29591
augaagacuaucauugcuuugagcuacauuuucugucugguuuucgcccaagaccuuccaggaaaugacaacagcacagcaacucuuugccugggacaucaugcggugccaaacggaacgcuagugaaaacaaucacgaaugaucagauugaagugacuaaugcuacugaacugguucagaguuccucaacggguaaaauaugcgacaauccucaucgaauccuugauggaauaaacugcacacugauagaugcucuauugggggacccucauugugauggcuuucaaaaugagaaaugggaccuuuucguugaacgcagcaaagcuuucagcaacuguuacccuuaugaugugccagauuaugccucccuuaggucacuaguugccucgucaggcacucuggaguuuaucaaugaaggcuucaauuggacuggggucacucagaaugggggaagcagugcuugcaaaaggggaccugauaacgguuuuuucaguagacugaacugguuguacaaaucaggaagcacauauccagugcagaacgugaccaugccaaacaaugacaacucugacaaacuauacauuugggggguucaccacccgagcacggacaaagaacaaaccaaccuauauguucaagcaucagggaaagucacagucuccaccaagagaagccagcaaacuguaaucccgaaugucgggucuagacccuggguaaggggucuaucuaguagaguaagcaucuauuggacaauaguuaaaccgggagacauacugguaauuaauaguaauggaaaccuaauugcuccucgggguuacuacaaaaugcgcacugggaaaagcucaauaaugaggucagaugcaccuauuggcacuugcagcucugaaugcaucacuccaaauggaagcauucccaaugacaagcccuuucaaaacguaaacaagaucacauauggggcaugucccaaguauguuaagcaaaacacucugaaguuggcaacagggaugcggaauguaccagagaaacaaacuagaggcauauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaacugaauaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaaugggacuuaugaccaugauguauacagagacgaagcauuaaacaaccgguuucagaucaaagguguugaacugaagucaggauacaaagacuggauccuguggauuuccuuugccauaucaugcuuuuugcuuuguguuguuuugcugggguucaucaugugggccugccagaaaggcaacauuaggugcaacauuugcauuuag

SEQ ID NO: 37350 - RNA, 1701 nt, Artificial Sequence; identical to SEQ ID NO: 30547
  hemagglutinin__InfluenzaA__AEI54347

SEQ ID NO: 37351 - RNA, 1701 nt, Artificial Sequence
  hemagglutinin__InfluenzaA__AEI54358
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguacagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuagaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauauuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37352 - RNA, 1701 nt, Artificial Sequence
  hemagglutinin__InfluenzaA__AEI54369
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaauugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauagcaguuucuuuaguagauugaauugguugacccacuuaaaauucaaauacccagcauugaacgugacuaugccaaacaaugaagaauuugacaaauuguacauuugggggguucaccacccggguacauacaaugaccaaaucagccuauaugcucaagcaucaggaagaaucacagucucuaccaaaagaagccaacaaacuguaaucccgaauaucgggucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37353 - RNA, 1701 nt, Artificial Sequence; identical to SEQ ID NO: 31024
  hemagglutinin__InfluenzaA__AEI54380

SEQ ID NO: 37354 - RNA, 1701 nt, Artificial Sequence; identical to SEQ ID NO: 37283
  hemagglutinin__InfluenzaA__AEI54391

SEQ ID NO: 37355 - RNA, 1701 nt, Artificial Sequence
  hemagglutinin__InfluenzaA__AEI54402
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcuacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugagugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaagaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37356 - RNA, 1701 nt, Artificial Sequence
  hemagglutinin__InfluenzaA__AEI54413
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucaucuggcacacuggaguuuaacaaugaaagcuucaauuggacuggagucacucaaaacggaacaagcucugcuugcauaaggagaucuaacaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcauuuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaaguacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37357 - RNA, 1701 nt, Artificial Sequence; identical to SEQ ID NO: 37307
  hemagglutinin__InfluenzaA__AEI54424

SEQ ID NO: 37358 - RNA, 1701 nt, Artificial Sequence
  hemagglutinin__InfluenzaA__AEI54446
augaagacuaucauugcuuugagcuacauucuaugucugguuuucgcucaaaaacuuccugaaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaauuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37359 - RNA, 1701 nt, Artificial Sequence
  hemagglutinin__InfluenzaA__AEI54457
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaauuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37360 - RNA, 1701 nt, Artificial Sequence
  hemagglutinin__InfluenzaA__AEI54468
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugccugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccaggagacauacuuuugauuaacagcacagggaaucuaauugcuccuagggguuacuucaaaauacgaaguggaaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucacaauauaccacaaaugugacaaugccugcauaggaucaaucagaaauggaacuuaugaccacaauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37361 - RNA, 1701 nt, Artificial Sequence; identical to SEQ ID NO: 36037
  hemagglutinin__InfluenzaA__AEI54479

SEQ ID NO: 37362 - RNA, 1701 nt, Artificial Sequence
  hemagglutinin__InfluenzaA__AEI54490
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauauccagcauugaacgugacuaugccaaacaaugaacaauuugacaaauuguacauuuggggaguucaccacccggguacggacaaggaccaaaucuuccuguaugcucaagcagcaggaagaaucacaguaucuaccaaaagaagccaacaagcuguaauuccgaauauuggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaccaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37363 - RNA, 1701 nt, Artificial Sequence
  hemagglutinin__InfluenzaA__AEI54501
augaagacuaucauugcuuugagcuacauucuaugucugguuuucgcucaaaaacuuccugaaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugaaaaauauguugaggacacuaaaauagaucucuggucauacaacgcggagcuucuuguugcccuggagaaccaacacacaauugaucuaacugacucagaaaugaacaaauuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37364 - RNA, 1701 nt, Artificial Sequence
  hemagglutinin__InfluenzaA__AEI59979
augaagacuaucauugcuuugagcuacauucuaugucugguuuucgcucaaaaacuuccuggaaaugacaacagcacggcaacgcugugccuugggcaucaugcaguaccaaacggaacgauagugaaaacaaucacgaaugaccaaauugaaguuacuaaugcuacugagcugguucagauuuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauuaaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaaacugaauagauugaucgagaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccuguauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37365 - RNA, 1698 nt, Artificial Sequence; identical to SEQ ID NO: 36461
  hemagglutinin__InfluenzaA__AEI59990

SEQ ID NO: 37366 - RNA, 1698 nt, Artificial Sequence; identical to SEQ ID NO: 36463
  hemagglutinin__InfluenzaA__AEI60001

SEQ ID NO: 37367 - RNA, 1701 nt, Artificial Sequence
  hemagglutinin__InfluenzaA__AEI60012
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggaguucuaauaacaguuucuuuaguagauugaauugguugacccacuuaaaauucaaauacccagcauuaaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaacaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggaaaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37368 - RNA, 1701 nt, Artificial Sequence; identical to SEQ ID NO: 35885
  hemagglutinin__InfluenzaA__AEI60023

SEQ ID NO: 37369 - RNA, 1701 nt, Artificial Sequence
  hemagglutinin__InfluenzaA__AEI60034
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37370 - RNA, 1701 nt, Artificial Sequence
  hemagglutinin__InfluenzaA__AEI60045
augaagacuaucauugcuuugagcuacauucuaugucugguuuucgcucaaaaacuuccuggaaaugacaacagcacggcaacgcugugccuugggcaucaugcaguaccaaacggaacgauagugaaaacaaucaugaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggauauagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37371 - RNA, 1701 nt, Artificial Sequence
  hemagglutinin__InfluenzaA__AEI60086
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaacacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37372 - RNA, 1701 nt, Artificial Sequence
  hemagglutinin__InfluenzaA__AEI60109
augaagacuaccauugcuuugagcuacauuuuaugucugguuuuugcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaauuccucaacagguagaauaugcgacaguccucaccaaauccuugauggagaaaacugcacacuaauagaugcucuauugggugacccucauugugauggcuuccaaaauaaggaaugggaccuuuuuguugaacgcagcaaagccuacagcaacuguuacccuuauaaugugccagauuaugucucccuuaggucacuaguugccucaucaggcacgcuggaguuuaacaaugaaagcuucaauuggacuggagucgcucaggauggaucaagcuaugcuugcaaaaggagaucuaauaaaaguuuuuuuaguagauugaauugguugcaucaauuaaauuacaaauauccagcacugaacgugacuaugccaaacaaugaaaacuuugacaaauuguacauuugggggguucaccacccagguacagacagugaccaaaucagucuauaugcucaagcaucagggagggucacagucucuaccaaaaggagccaacaaacuguaaucccgaauaucggauauagacccuggguaaggggugucucuagcauaauaagcaucuauuggacaauaguaaaaccgggagacauacucuugauuaacagcacaggaaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauaugggcccugucccagauauguuaaacaaaacacuuugaaauuagcaacagggaugcggaaugugccagagaagcaaacuagaggcauauucggugcaaucgcgggcuucauagaaaauggcugggaaggaaugaaggacgguugguacgguuucaggcaucaaaauucugagggcacagggcaagcagcagauauuaaaagcacucaagcagcaaucaaccaaaucaacggaaaacugaauagguuaaucgagaaaacaaacgagaaauuccaucaaauugaaaaagaauucucagaaguagaagggagaauucaggaccucgagaaauaugucgaggacacuaaaauagaucucuggucguacaaugcggagcuucuuguugcccuggagaaccaacauacaauugaucuaacugacucagagaugaacaaacuguuugaaagaacaaagaaacaacugagagaaaaugcugaggauaugggcaaugguuguuucaaaauauaccacaaaugugacaauaccugcauuggaucaaucagaaauggaacuuaugaccacgauguauacagagacgaagcauugaacaaccgguuccauaucaaagguguugagcugaagucaggauacaaagauuggauccuauggauuuccuuugccacaucaugcuuucugcuuuguauuguuuugcugggguucaucaugugggccugccaaaaaggcaacauuagaugcaacauuugcauuuga

SEQ ID NO: 37373 - RNA, 1701 nt, Artificial Sequence
  hemagglutinin__InfluenzaA__AEI86734
augaaggcaauacuaguaguucugcuauauacauuugcaaccgcaaaugcagacacauuauguguagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauaguggaaacaucuaauucagacaauggaacguguuacccaggagauuucaucgauuaugaggagcuaagagagcaguugagcucagugucaucauuugaaagguuugagauauuccccaagacaaguucauggcccaaucaugacucgaacaaagguguaacggcagcauguccucaugcuggggcaaaaagcuucuacagaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccuucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuugaauaaaaaaguugaugaugguuuccuggacauuuggacuuacaaugccgaacuguugguucuauuggaaaaugaaagaacuuuggacuaccaugauucaaaugugaagaacuuauaugaaaagguaagaagccaguugaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37374 - RNA, 1701 nt, Artificial Sequence
  hemagglutinin__InfluenzaA__AEI86764
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaauuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagaacaauugagcucagugucaucauuugaaagguuugagauauuccccaagacaaguucauggcccgaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacuaguagucucccugggggcaaucaguuucuggaugugcucuaaugggucucuacaauguagaauauguauuuaa

SEQ ID NO: 37375 - RNA, 1701 nt, Artificial Sequence; identical to SEQ ID NO: 37374
  hemagglutinin__InfluenzaA__AEI86774

SEQ ID NO: 37376 - RNA, 1701 nt, Artificial Sequence
  hemagglutinin__InfluenzaA__AEI86784
augaagguaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuuaaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37377 - RNA, 1701 nt, Artificial Sequence
  hemagglutinin__InfluenzaA__AEI86794
augaagacaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaauuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggaaauuucaucgauuaugaggagcuaagagaacaauugagcucagugucaucauuugaaagguuugagauauuccccaagacaaguucauggcccgaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaauaagacccaaagugagggaucaagaagggagaaugaacuauuacuggacacuaguagagccgggagacaaaauaacauucgaagcaacuggaaaucuaguggcaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucuggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37378 - RNA, 1701 nt, Artificial Sequence
  hemagglutinin__InfluenzaA__AEI86804
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccgaucaugacucuaacaaagguguaacggcagcauguccucaugcuggagcaaaaagcuucuacaaaaauuuaauguggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagucucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuaccccaaauacucagaggaagcaaaauuaaacagagaagaaauagaugggguaaagcuggaaucaacaaggauuuaccagauuuuggcgaucuauucagcugucgccaguucauugguacugguagucucccugggggcaaucaguuucuggaugugcucuaaugggucucuacaguguagaauauguauuuaa

SEQ ID NO: 37379 - RNA, 1701 nt, Artificial Sequence
  hemagglutinin__InfluenzaA__AEI86814
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaauuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagaacaauugagcucagugucaucauuugaaagguuugagauauuccccaagacaaguucauggcccgaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaaaggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacuaguagucucccugggggcaaucaguuucuggaugugcucuaaugggucucuacaauguagaauauguauuuaa

SEQ ID NO: 37380 - RNA, 1701 nt, Artificial Sequence
  hemagglutinin__InfluenzaA__AEI86824
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaauuaugcaaacuaagagggguagccccauugcauuugggcaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagaacaauugagcucagugucaucauuugaaagguuugagauauuccccaagacaaguucauggcccgaucaugacucgaacaaagguguaacggcagcauguccucaugcuggagcaaaaagcuucuacaaaaacuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacaggaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagagaaaauagaugggguaaagcuggaaucaacaaggauuuaccagauuuuggcgaucuauucaacugucgccaguucauugguacuaguagucucccugggggcaaucaguuucuggaugugcucuaaugggucucuacaauguagaauauguauuuaa

SEQ ID NO: 37381 - RNA, 1701 nt, Artificial Sequence
  hemagglutinin__InfluenzaA__AEI86834
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaauuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggaaauuucaucgauuaugaggagcuaagagaacaauugagcucagugucaucauuugaaagguuugagauauuccccaagacaaguucauggcccgaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaggaaguucaagccggaaauagcaauaagacccaaagugagggaucaagaagggagaaugaacuauuacuggacacuaguagagccgggagacaaaauaacauucgaagcaacuggaaaucuaguggcaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucuggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37382 - RNA, 1701 nt, Artificial Sequence
  hemagglutinin__InfluenzaA__AEI86854
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacaucgcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccgaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaguuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37383 - RNA, 1701 nt, Artificial Sequence
  hemagglutinin__InfluenzaA__AEI86864
augaaggcaauauuaguagcucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauagcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacaccuaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37384 - RNA, 1701 nt, Artificial Sequence; identical to SEQ ID NO: 37374
  hemagglutinin__InfluenzaA__AEI86874

SEQ ID NO: 37385 - RNA, 1701 nt, Artificial Sequence
  hemagglutinin__InfluenzaA__AEI86894
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaauuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggaaauuucaucgauuaugaggagcuaagagaacaauugagcucagugucaucauuugaaagguuugagauauuccccaagacaaguucauggcccgaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuaguggcaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucuggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37386 - RNA, 1701 nt, Artificial Sequence
  hemagglutinin__InfluenzaA__AEI86904
augaaggcaauacuaguaguucugcuauauacauuuacaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuagguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauccaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggauuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37387 - RNA, 1701 nt, Artificial Sequence
  hemagglutinin__InfluenzaA__AEI86914
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaggcucagcaaauccuacauuaaugauaaagggaaagaaguccucgugcuauggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37388 - RNA, 1701 nt, Artificial Sequence
  hemagglutinin__InfluenzaA__AEI86924
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggaguuuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaauuaaaaaaggaaauucauacccaaagcucagcaaauccuacauuaaugauaaagggaaagaaguccucgugcuauggggcauucaccauccaucuacuacugcugaccaacaaagucucuaucagaaugcagaugcauauguuuuuguagggacaucaagauacagcaagaaguucaagccggaaauagcaguaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccaucgacaagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuauccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37389 - RNA, 1701 nt, Artificial Sequence
  hemagglutinin__InfluenzaA__AEI86934
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaauuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagaacaauugagcucagugucaucauuugaaagguuugagauauuccccaagacaaguucauggcccgaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggagauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacuaguagucucccugggggcaaucaguuucuggaugugcucuaaugggucucuacaauguagaauauguauuuaa

SEQ ID NO: 37390 - RNA, 1701 nt, Artificial Sequence
  hemagglutinin__InfluenzaA__AEI86944
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuauguaaacuaagagggguagccccauugcauuuggguaaauguaacaucgcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccgaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggcuacaggauugagaaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaguuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37391 - RNA, 1701 nt, Artificial Sequence
  hemagglutinin__InfluenzaA__AEI86964
augaaggcaauacuaguaguucuacuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggaguuuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagaugcauauguuuuuguggggacaucaagauacagcaagaaguucaagccggaaauagcaguaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccaucgacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacaugugcauggaaagugucaaaaaugggacuuaugacuauccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37392 - RNA, 1701 nt, Artificial Sequence
  hemagglutinin__InfluenzaA__AEI86974
augaaggcaauacuaguaguucugcuauauacauuugcaaccgcaaaugcagacacauuauguauagguuaucaugcgaacaauucaacagacacuguagacacaguacuagaaaagaaugugacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccuugugcuauggggcauucaccauccaucuacuagugcugaccaacaaagucucuaucagaaugcagaugcauauguuuuuguggggacaucaaaauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37393 - RNA, 1701 nt, Artificial Sequence
  hemagglutinin__InfluenzaA__AEI86984
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaauuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagggaacaauugagcucagugucaucauuugaaagguuugagauauuccccaagacaaguucauggcccgaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaaggaaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacgccaguccacgauugcaauacaacuugucagacacccaagggugcuauaaacaccagccucccauuucagaauauacauccgaucacaaucggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuguuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacuaguagucucccugggggcaaucaguuucuggaugugcucuaaugggucucuacaguguagaauauguauuuaa

SEQ ID NO: 37394 - RNA, 1701 nt, Artificial Sequence; identical to SEQ ID NO: 37382
  hemagglutinin__InfluenzaA__AEI86994

SEQ ID NO: 37395 - RNA, 1701 nt, Artificial Sequence
  hemagglutinin__InfluenzaA__AEI87004
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaauuaugcaaacuaaaagggguagccccauugcauuuggguaaauguaacauugcuggcuggauccugggaaauccagagugugaaucacucuccacagcaagcucaugguccuacauuguggaaacaucuaguucagacaauggaacguguuacccaggaaauuucaucgauuaugaggagcuaagagaacaauugagcucagugucaucauuugaaagguuugagauauuccccaagacaaguucauggcccgaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaggucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuaguggcaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucuggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37396 - RNA, 1701 nt, Artificial Sequence
  hemagglutinin__InfluenzaA__AEI87014
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucaggggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37397 - RNA, 1701 nt, Artificial Sequence
  hemagglutinin__InfluenzaA__AEI87034
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacaucgcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccgaccaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaauagguaaagaguucaaccaccuggaaaaaagaauagagaauuuaaauaaaaaaguugaugaugguuuccuggacauuuggacuuacaaugcugaacuguugguucuauuggaaaaugaaagaacuuuggacuaccacgauucaaaugugaagaacuuauaugaaaagguaagaagccaguuaaaaaacaaugccaaggaaauuggaaacggcugcuuugaguuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37398 - RNA, 1701 nt, Artificial Sequence
  hemagglutinin__InfluenzaA__AEI87044
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaauuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuauccaggagauuucaucgauuaugaggagcuaagagaacaauugagcucagugucaucauuugaaagguuugagauauuccccaagacaaguucauggcccgaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37399 - RNA, 1701 nt, Artificial Sequence
  hemagglutinin__InfluenzaA__AEI87054
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacaucgcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagguaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaguuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37400 - RNA, 1701 nt, Artificial Sequence
  hemagglutinin__InfluenzaA__AEI87064
augaaggcaauacuaguaguucugcuauauacauuugcaaccgcaaaugcagacacauuauguauagguuaucaugcgaacaauucaacagacacuguagacaccguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuuuuggaugugcucuaaugggucucuacaguguagaauauguauuuaa

SEQ ID NO: 37401 - RNA, 1701 nt, Artificial Sequence
  hemagglutinin__InfluenzaA__AEI87074
augaaggcaacacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37402 - RNA, 1701 nt, Artificial Sequence
  hemagglutinin__InfluenzaA__AEI87094
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaauuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagaacaauugagcucagugucaucauuugaaagguuugagauauuccccaagacaaguucauggcccgaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaauacuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggauaaagcuggaaucaacaaggauuuaccagauuuuggcgaucuauucaacugucgccaguucauugguacuaguagucucccugggggcaaucaguuucuggaugugcucuaaugggucucuacaauguagaauauguauuuaa

SEQ ID NO: 37403 - RNA, 1701 nt, Artificial Sequence; identical to SEQ ID NO: 37402
  hemagglutinin__InfluenzaA__AEI87104

SEQ ID NO: 37404 - RNA, 1698 nt, Artificial Sequence; identical to SEQ ID NO: 36496
  hemagglutinin__InfluenzaA__AEI91963

SEQ ID NO: 37405 - RNA, 1701 nt, Artificial Sequence; identical to SEQ ID NO: 34563
  hemagglutinin__InfluenzaA__AEI91977

SEQ ID NO: 37406 - RNA, 1701 nt, Artificial Sequence; identical to SEQ ID NO: 35861
  hemagglutinin__InfluenzaA__AEI91978

SEQ ID NO: 37407 - RNA, 1701 nt, Artificial Sequence
  hemagglutinin__InfluenzaA__AEI91998
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaguguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugauagucucccugggggcaaucaguuucuggaugugcucuaaugggucucuacaguguagaauauguauuuaa

SEQ ID NO: 37408 - RNA, 1701 nt, Artificial Sequence
  hemagglutinin__InfluenzaA__AEI91999
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaacuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucucaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37409 - RNA, 1698 nt, Artificial Sequence
  hemagglutinin__InfluenzaA__AEI92018
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauagcugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 37410 - RNA, 1701 nt, Artificial Sequence
  hemagglutinin__InfluenzaA__AEJ10400
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaauuaugcaaacuaagagggguagccccauugcauuuggguaaauguaacauugcuggcuggauccuaggaaauccagagugugaaucacucuccacagcaagcucaugguccuacauuguggaaacauccaguucagacaauggaacguguuacccaggaaauuucaucgauuaugaggagcuaagagaacaauugagcucagugucaucauuugaaagguuugagauauuccccaagacaaguucauggcccgaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuuguggcaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucuggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaauuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37411 - RNA, 1701 nt, Artificial Sequence
  hemagglutinin__InfluenzaA__AEJ10410
augaagacaauacuaguaguucugcuauauacauuugcaaccgcaaaugcagacacauuauguauagguuaucaugcgaacaauucaacagacacuauagacacaguacuagaaaagaauguaacaguaacacacucuguuaaccuucuagaagacaagcauaacgggaaauuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggaaauuucaucgauuaugaggagcuaagagaacaauugagcucagugucaucauuugaaagguuugagauauuccccaagacaaguucaugguccgaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuaguggcaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucuggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37412 - RNA, 1701 nt, Artificial Sequence
  hemagglutinin__InfluenzaA__AEJ10420
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaggcauaacgggaaacuaugcaaacuaagagggguagccccauugcauuuggguaaauguaacaucgcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccgaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggcuacaggauugagaaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaguuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37413 - RNA, 1701 nt, Artificial Sequence
  hemagglutinin__InfluenzaA__AEJ10430
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacgacagcauguccucaugcuggagcaaaaagcuucuacaaaaauuuaauauggcuaguuaaaaaaggaaauucauacccaaaacucagcaaauccuacauuaaugauaaagggaaagaaguccucgugcuauggggcauucaccauccaccuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggguaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugugauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37414 - RNA, 1701 nt, Artificial Sequence
  hemagglutinin__InfluenzaA__AEJ10440
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaauucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 37415 - RNA, 1701 nt, Artificial Sequence
  hemagglutinin__InfluenzaA__AEJ10450
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaaaacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 37416 - RNA, 1701 nt, Artificial Sequence
  hemagglutinin__InfluenzaA__AEJ10480
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacugagagggguagccccauugcauuuggguaaauguaacauugcuggcuggauccugggaaauccagagugugaaucacucuccacagcaagcucaugguccuacaucguggaaacaucuaguucagacaauggaacgugcuacccaggagauuucaucaauuaugaggagcuaagagagcaauugagcucagugucaucauuugaaagguuugagauauuccccaagacaaguucauggcccaaucaugacucgaacaaagguguaacggcagcauguccucaagcuggagcaaaaagcuucuacaaaaauuuaauauggcuaguuaaaaaaggaaauucauacccaaagcucagcaaauccuacauuaacgauaaagggaaagaaguccucgugcuauggggcauucaccauccaucuacuagugcugaccaacaaagucucuaucagagugcagaugcauauguuuuuguggggacaucaaaauacagcaagaaguucaagccggaaauagcaguaagacccaaagugagggaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaaugucccaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugcgcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaaaaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37417 - RNA, 1701 nt, Artificial Sequence
  hemagglutinin__InfluenzaA__AEJ10490
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacgacagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaccuacuagugcugaccaacaaagucucuaucagaaugcagaugcauauguuuuuguggggacaucaagauacagcaagaaauucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaagauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgggauuacuaacaaaguaaauucuguuauugaaaagaugaauacacaguucacagcaguagguaaagaguucaaccaccuggaaaaaagaauagaaaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugugauaacacgugcauggaaagugucaaaaaugggacuuaugacuacccaaaauacucagaggaagcaaaauuaaacagagaagaaauagaugggguaaagcuggaaucaacaaugauuuaccagauuuuggcgaucuauucaaccgucgccaguucauugguacugauagucucccugggggcaaucaguuucuggaugugcucuaaugggucucuacaguguagaauauguauuuaa

SEQ ID NO: 37418 - RNA, 1701 nt, Artificial Sequence
  hemagglutinin__InfluenzaA__AEJ10500
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaaggcaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaaaacaaguucauggcccaaucaugacucgaacaaagguguaacggcagcauguccucaugcuggagcaaaaggcuucuacaaaaauuuaauauggcuaguuaaaaaaggaaauucauacccaaagcucaacaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuaccaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 37419 - RNA, 1701 nt, Artificial Sequence
  hemagglutinin__InfluenzaA__AEJ10510
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaauuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37420 - RNA, 1701 nt, Artificial Sequence
  hemagglutinin__InfluenzaA__AEJ10520
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaauuaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguucaaaauauguaaaaagcacaaaauugagacuggccacuggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaaaaugaauacacaauucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37421 - RNA, 1701 nt, Artificial Sequence
  hemagglutinin__InfluenzaA__AEJ10530
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaauucacagcaguagguaaagaguucaaccaccuagaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37422 - RNA, 1701 nt, Artificial Sequence; identical to SEQ ID NO: 36995
  hemagglutinin__InfluenzaA__AEJ10540

SEQ ID NO: 37423 - RNA, 1701 nt, Artificial Sequence; identical to SEQ ID NO: 36995
  hemagglutinin__InfluenzaA__AEJ10550

SEQ ID NO: 37424 - RNA, 1701 nt, Artificial Sequence
  hemagglutinin__InfluenzaA__AEJ10570
augaaggcaauacuaguaguucugcuauauacauuagcaaccgcaaaugcagacacauuauguauagguuaucaugcgaacaauucaacagacacuguagacacaguacuagaaaagaauguaacaguaacacacucuguuaaccuucuagaagacaagcaugacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaagagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaaggaaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaaugcaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuacuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37425 - RNA, 1701 nt, Artificial Sequence
  hemagglutinin__InfluenzaA__AEJ10580
augaaggcaauacuaguaguucugcuauauacauuagcaaccgcaaaugcagacacauuauguauagguuaucaugcgaacaauucaacagacacuguagacacaguacuagaaaagaauguaacaguaacacacucuguuaaccuucuagaagacaagcaugacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaagagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaaugcaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuacuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37426 - RNA, 1701 nt, Artificial Sequence
  hemagglutinin__InfluenzaA__AEJ36302
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucauacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaaggcucuaucagaaugcagaugcauaugcuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccagcccaugauugcaauacaacuugucagacacccaagggugcuauaaacaccagccucccauuucagaauguacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaucaucaaaaugagcaggggucaggauaugcagccgaccugaagagcacacagaaugccuuugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaacuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37427 - RNA, 1701 nt, Artificial Sequence
  hemagglutinin__InfluenzaA__AEJ36312
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacaucgcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccgaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauauacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaguuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37428 - RNA, 1701 nt, Artificial Sequence
  hemagglutinin__InfluenzaA__AEJ37853
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggaucuuggggaauccagagugugaaucacucucuacagcaagcucaugguccuacauuguggaagcaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacaugugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37429 - RNA, 1701 nt, Artificial Sequence
  hemagglutinin__InfluenzaA__AEJ37863
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggccuaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaacugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaaggaggguggacagggaugguagaugggugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggaccuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37430 - RNA, 1701 nt, Artificial Sequence
  hemagglutinin__InfluenzaA__AEJ37873
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaaggaggguggacagggaugguagaugggugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37431 - RNA, 1701 nt, Artificial Sequence; identical to SEQ ID NO: 37385
  hemagglutinin__InfluenzaA__AEJ37883

SEQ ID NO: 37432 - RNA, 1701 nt, Artificial Sequence
  hemagglutinin__InfluenzaA__AEJ37893
augaaggcaauacuaguaguucugcuauauacauuugcaaccacaaaugcagacacauuauguauagguuaucaugcgaacaauucaacagacacuguagacacaguacuggaaaagaauguaacaguaacacacucuguuaaccuucuagaagacaagcauaacgggaaauuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggaaauuucaucgauuaugaggagcuaagagaacaauugagcucagugucaucauuugaaagguuugagauauuccccaagacaaguucauggcccgaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuaguggcaccgagauaugcauucgcaauggaaagaaaugcuggaucugguauuaucauuucagauaaaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucuggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37433 - RNA, 1701 nt, Artificial Sequence; identical to SEQ ID NO: 37385
  hemagglutinin__InfluenzaA__AEJ37903

SEQ ID NO: 37434 - RNA, 1701 nt, Artificial Sequence
  hemagglutinin__InfluenzaA__AEJ37923
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaauuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggaaauuucaucgauuaugaggagcuaagagaacaauugagcucagugucaucauuugaaagguuugagauauuccccaagacaaguucauggcccgaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuaguggcaccgagauaugcauucgcaauagaaagaauggcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucuggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37435 - RNA, 1701 nt, Artificial Sequence
  hemagglutinin__InfluenzaA__AEJ37943
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuaucacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaaggaggguggacagggaugguagaugggugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37436 - RNA, 1701 nt, Artificial Sequence
  hemagglutinin__InfluenzaA__AEJ37953
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaauuaugcaaacuaagagggguagccccauugcauuuggguaaauguaacauugcuggcuggauccugggaaauccagagugugaaucacucuccacagcaagcucaugguccuacauuguggaaacaucuaguucugacaauggaacguguuacccaggaaauuucaucgauuaugaggagcuaagagaacaauugagcucagugucaucauuugaaagguuugagauauuccccaagacaaguucauggcccgaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuaguggcaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucuggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37437 - RNA, 1701 nt, Artificial Sequence
  hemagglutinin__InfluenzaA__AEJ37963
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaauuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggaaauuucaucgauuaugaggagcuaagagaacaauugagcucagugucaucauuugaaagguuugagauauuccccaagacaaguucauggcccgaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuaguggcaccgagauaugcauucgcaauggaaagaaaugcuggaucugguauuaucauuucagauacaccaguccacgauugcaauacaacuugucagacacccaagggugcuacaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucuggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37438 - RNA, 1701 nt, Artificial Sequence
  hemagglutinin__InfluenzaA__AEJ37973
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaaggaggguggacagggaugguagaugggugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaauuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37439 - RNA, 1701 nt, Artificial Sequence
  hemagglutinin__InfluenzaA__AEJ37983
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaauuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggaaauuucaucgauuaugaggagcuaagagaacaauugagcucagugucaucauuugaaagguuugagauauuccccaagacaaguucauggcccgaucaugacucgaacaaagguguaacggcagcauguccucaugcuggagcaaaaagcuuuuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuaguggcaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucuggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37440 - RNA, 1701 nt, Artificial Sequence; identical to SEQ ID NO: 36535
  hemagglutinin__InfluenzaA__AEK21369

SEQ ID NO: 37441 - RNA, 1698 nt, Artificial Sequence; identical to SEQ ID NO: 36893
  hemagglutinin__InfluenzaA__AEK21380

SEQ ID NO: 37442 - RNA, 1701 nt, Artificial Sequence
  hemagglutinin__InfluenzaA__AEK21396
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguugaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaauaagacccaaagugagggaucaagaagggagaaugaacuauuacuggacacuaguagaaccgggagacaaaauaacauuugaagcaacuggaaaucuauugguaccgagauaugcauucgaaauggaaagaaaaucuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuucuggacauuuggacuuacaaugcugaacuguugguucuauuggaaaaugaaagaacuuuggacuaccacgauucaaaugugaagaacuuauaugaaaagguaagaagccaacuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37443 - RNA, 1701 nt, Artificial Sequence
  hemagglutinin__InfluenzaA__AEK21406
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacaucgcuggcuggauccugggaaauccagaaugugaaucacucuccacagcaagcucaugguccuacauuguggaaacaucuaguucagacaauggaacguguuacccaggagauuucaucgauuaugaggagcuaagagagcaauugagcucaaugucaucauuugaaagguuugagauauuccccaagacaaguucauggcccgaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaacacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaaacuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37444 - RNA, 1701 nt, Artificial Sequence
  hemagglutinin__InfluenzaA__AEK21416
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggaguuuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagaugcauauguuuuuguggggacaucaagauacagcaagaaguucaagccggaaauagcaguaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucaaaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccaucgacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuauccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37445 - RNA, 1701 nt, Artificial Sequence
  hemagglutinin__InfluenzaA__AEK21426
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaauuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggaaauuucaucgauuaugaggagcuaagagaacaauugagcucagugucaucauuugaaagguuugagauauuccccaagacaaguucauggcccgaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuaguggcaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaagaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucuggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37446 - RNA, 1701 nt, Artificial Sequence; identical to SEQ ID NO: 37430
  hemagglutinin__InfluenzaA__AEK21436

SEQ ID NO: 37447 - RNA, 1701 nt, Artificial Sequence
  hemagglutinin__InfluenzaA__AEK21456
augaaggcaauacugguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaaggaggguggacagggaugguagaugggugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaaaugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37448 - RNA, 1701 nt, Artificial Sequence
  hemagglutinin__InfluenzaA__AEK21466
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaauuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggaaauuucaucgauuaugaggagcuaagagaacaauugagcucagugucaucauuugaaagguuugagauauuccccaagacaaguucauggcccgaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuaguggcaccgagauaugcauucgcaauggaaagaaaugcugguucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucuggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37449 - RNA, 1701 nt, Artificial Sequence
  hemagglutinin__InfluenzaA__AEK21476
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaauuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggaaauuucaucgauuaugaggagcuaagagaacaauugagcucagugucaucauuugaaagguuugagauauuccccaagacaaguucauggcccgaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuaguggcaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucuggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuacuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37450 - RNA, 1701 nt, Artificial Sequence; identical to SEQ ID NO: 37430
  hemagglutinin__InfluenzaA__AEK21486

SEQ ID NO: 37451 - RNA, 1701 nt, Artificial Sequence
  hemagglutinin__InfluenzaA__AEK28774
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucccuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauucaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37452 - RNA, 1701 nt, Artificial Sequence
  hemagglutinin__InfluenzaA__AEK28785
augaagacuaucauugcuuugagcuacauucuaugucugguuuucgcucaaaaccuuccuggaaaugacaacagcgcggcaacgcugugccuugggcaccaugcaguaccaaacggaacgauagugaaaacaaucacgaaugaccaaguugagguuacuaaugcuacugagcugguucagaauuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagcauacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauucaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37453 - RNA, 1701 nt, Artificial Sequence
  hemagglutinin__InfluenzaA__AEK28796
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugacaaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacauuggaauuuaacaaugaaagcuucaauuggacuggagucacucaagacggaacaagcucugcuugcauaaggggaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaagcugcaaucccgaauaucggaucuagacccagaguaaggaacaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauucaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37454 - RNA, 1701 nt, Artificial Sequence
  hemagglutinin__InfluenzaA__AEK28807
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacggcaacuguuacccuuaugaugugccggauuaugccucccuuaggucacuaguugccucauccggcacacuggaguuuaacaaugaaagcuucaauuggaccggagucacucaaaacggaacaagcucugcuugcauaaggaaaucuaauaacaguuucuuuaguagauugaauugguugacccacuuaaaauucaaauacccagcauugaacguaacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaacucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauucaucuaacugacucagaaaugaacaaacuguuugaaaaaacaaagaagcaacugagggaaaaugcugaggauaugggcaaugguuguuucaaaauauaucacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37455 - RNA, 1701 nt, Artificial Sequence
  hemagglutinin__InfluenzaA__AEK28818
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacuguaaucccgaauaucggaucuagacccaggguaaggaauaucccuagcagaauaagcaucuauuggacaauaguaaaaccgggagacauacuuuugauuaacaacacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagagggcaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauucaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37456 - RNA, 1701 nt, Artificial Sequence
  hemagglutinin__InfluenzaA__AEK28828
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugaugggaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaaccguaaucccgaauaucggaucuagacccagaguaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauucaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggucugccaaaaaggcaacauuaggugcaacauuugcauuuga

SEQ ID NO: 37457 - RNA, 1701 nt, Artificial Sequence; identical to SEQ ID NO: 34453
  hemagglutinin__InfluenzaA__AEK28839

SEQ ID NO: 37458 - RNA, 1701 nt, Artificial Sequence
  hemagglutinin__InfluenzaA__AEK28850
augaagacuaucauugcuuugagcuacauucuaugucugguuuucgcucaaaaacuuccuggaaacgacaacagcacggcaacgcugugccuugggcaccaugcaguaccaaacggaacgauagugaaaacaaucacaaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacugugaucccgaauaucggaucuagacucagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacagaaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcuaaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37459 - RNA, 1701 nt, Artificial Sequence
  hemagglutinin__InfluenzaA__AEK28861
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacaguaucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucuaaaauuggcaacaggaaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauccaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugaaggaaaaugcugaggauaugggcaaugguuguuucaaaauauaccacaaaugugacaaugccugcauaggaucaaucagaaauggaacuuaugaccacgauguauacagagaugaagcauugaacaaccgguuccacaucaagggaguugagcugaagucaggguacaaagauuggauccuauggauuuccuuugccacaucauguuuuuugcuuuguguugcuuuguugggguucaucaugugggccugccaaaaaggcaacauuaggugcaacauuugcauuuga

SEQ ID NO: 37460 - RNA, 1701 nt, Artificial Sequence
  hemagglutinin__InfluenzaA__AEK28872
augaagacuaucauugcuuugagcuacauucuaugccuaguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauuaaacgugacuaugccaaacaaugaacaauuugacaaauuguacauuugggggguucaccacccggguacggacaaugaucaaaucuuccuguaugcucaagcaucaggaagaaucacagucucuaccaaaagaagccaacaaacuguaaucccgaauaucggaucuagacccagaguaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugagugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcgggcuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauucaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37461 - RNA, 1701 nt, Artificial Sequence
  hemagglutinin__InfluenzaA__AEK28883
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaacggaacaagcucugcuugcauaaggagaucuaguaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauucaucugacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37462 - RNA, 1701 nt, Artificial Sequence
  hemagglutinin__InfluenzaA__AEK28894
augaagacuaucauugcuuugagcuacauucuaugucugguuuucgcucaaaaacuuccuggaaacgacaacagcacggcaacgcugugccuugggcaccaugcaguaccaaacggaacgauagugaaaacaaucacaaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacugugaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacagaaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcuaaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauucaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37463 - RNA, 1701 nt, Artificial Sequence
  hemagglutinin__InfluenzaA__AEK28905
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucaucuggcacacuggaguuuaacaaugaaagcuucaauuggacuggagucacucaaaacggaacaagcucugcuugcauaaggagaucuaauaacaguuucuuuaguagauugaauugguugacccacuuaagauucaaauacccagcauugaacgugacuaugccaaacaaugaacaauuugacaaauuguacauuugggggguucaccacccggguacggacaaugaccaaaucuucccguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacagaaucacauacggggccugucccagauauguuaagcaaaacacucugaaauuggcaacagggaugcgaaauguaccagagaaacaaacuagaggcauauuuggagcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugauucagaaaugaacaaacuguuugaaaaaacaaagaagcaacugagggaaaaugcugaagauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37464 - RNA, 1701 nt, Artificial Sequence
  hemagglutinin__InfluenzaA__AEK28916
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguccaccacccggguacggacaaugaccaaaucuuccuguaugcucaagcaucaggaagaaucacagucucuaccaaaagaagccaacaaacuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaguaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuagagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37465 - RNA, 1701 nt, Artificial Sequence
  hemagglutinin__InfluenzaA__AEK28927
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauuaaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaauugaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauucaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37466 - RNA, 1701 nt, Artificial Sequence
  hemagglutinin__InfluenzaA__AEK28949
augaagacuaucauugcuuugagcuacauucuaugucuaguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauuaaacgugacuaugccaaacaaugaacaauuugacaaauuguacauuugggggguucaccacccagguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguugucucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37467 - RNA, 1701 nt, Artificial Sequence
  hemagglutinin__InfluenzaA__AEK28960
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaguucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37468 - RNA, 1701 nt, Artificial Sequence
  hemagglutinin__InfluenzaA__AEK28971
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauuaaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccagaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugccuuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37469 - RNA, 1701 nt, Artificial Sequence
  hemagglutinin__InfluenzaA__AEK28982
augaagacuaucauugcuuugagcuacauucuaugucugguuuucgcucaaaaacuuccuggaaauuacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggaccggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagauauacuuuugauuaacagcacagggaaucuaauugcuccuagggguuacuucaaaauacgaagugggaaaagcucaauaaugagaucagaugcacccauuggcaaaugcaacucugaaugcaucacuccaaauggaagcauucccaaugacaaaccauuccaaaauguaaacaggaucacauacggggccugccccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucuauggucauacaacgcggagcuucuuguugcccuggagaaccaacauacaauucaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37470 - RNA, 1701 nt, Artificial Sequence
  hemagglutinin__InfluenzaA__AEK28993
augaagacuaucauugcuuugagcuacauucuaugucugguuuucgcucaaaaacuuccuggaaauuacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggaccggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagauauacuuuugauuaacagcacagggaaucuaauugcuccuagggguuacuucaaaauacgaagugggaaaagcucaauaaugagaucagaugcacccauuggcaaaugcaacucugaaugcaucacuccaaauggaagcauucccaaugacaaaccauuccaaaauguaaacaggaucacauacggggccugccccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucuauggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37471 - RNA, 1701 nt, Artificial Sequence
  hemagglutinin__InfluenzaA__AEK29004
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaagucacuaaugcuacugagcugguccagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugucucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaguacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacuuugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaauggaaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37472 - RNA, 1701 nt, Artificial Sequence
  hemagglutinin__InfluenzaA__AEK29026
augaagacuaucauugcuuugagcuacauucuaugucugguuuucgcucagaaacuuccuggaaaugacaacagcacggcaacgcugugccuugggcaccaugcaguaccaaacggaacgauagugaaaacaaucacgaaugaccaaauugaaguuacuaaugcuacugagcugguucagaguucuucaacaggugaaauaugcgacaguccucaucagauccuugaugggaaaaacugcacacuaauagaugcucuauugggagacccucagugugauggcuuccaagauaagaaaugggaccuuuuuguugaacgcagcaaagccuacagcaacuguuacccuuaugaugugccggauuaugccucccuuaggucacuaguugccucauccggcacacuggaauuuaacaaugaaagcuucaauuggacuggagucacucaaaacggaacaagcucugcuugcauaaggagaucuaaaaacaguuucuuuaguagauugaauugguugacccacuuaaacuucaaauacucagcauugaacgugacuaugccgaacaaugaacaauuugacaaauuguacauuugggggguucaccacccggguacggacaaagaccaaaucuuccuguaugcucaagcaucaggaagaaucacagucucuaccaaaaggagccaacaaacuguaaucccgaauaucggaucuagaccccgaguaaggaauaucccuagcagaauaagcaucuauuggacaauaguaaaaccgggagacauacuuuugauuaacagcacagggaaucuaauugcuccuagggguuacuucaaaaugcaaagugggaaaagcucaauaaugagaucagaugcacccauuggcaaaugcaauucugaaugcaucacuccaaauggaagcauucccaaugacaaaccauuccaaaaugugaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37473 - RNA, 1701 nt, Artificial Sequence
  hemagglutinin__InfluenzaA__AEK29048
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucgcucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaggcuguaaucccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaaugguagcauucccaaugacaaaccauuccaaaauguaaacaggaucacauacggggccugucccagauauguuaagcaaaacacucugaaguuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37474 - RNA, 1701 nt, Artificial Sequence
  hemagglutinin__InfluenzaA__AEK29070
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacugacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuuaauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauucaucuaacugacucagaaaugaacaaacuguuugaaaaaacaaagaagcaacugagggaaaaugcugaggauaugggcaaugguuguuucaaaauauaccacaaaugugacaacgccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37475 - RNA, 1701 nt, Artificial Sequence
  hemagglutinin__InfluenzaA__AEK29081
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucuucuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacugacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuuaauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauucaucuaacugacucagaaaugaacaaacuguuugaaaaaacaaagaagcaacugagggaaaaugcugaggauaugggcaaugguuguuucaaaauauaccacaaaugugacaacgccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37476 - RNA, 1701 nt, Artificial Sequence
  hemagglutinin__InfluenzaA__AEK29092
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaaguggaaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucacaauauaccacaaaugugacaaugccugcauaggaucaaucagaaauggaacuuaugaccacaauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaauauuaggugcaacauuugcauuuga

SEQ ID NO: 37477 - RNA, 1701 nt, Artificial Sequence
  hemagglutinin__InfluenzaA__AEK29125
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaauuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37478 - RNA, 1701 nt, Artificial Sequence; identical to SEQ ID NO: 37477
  hemagglutinin__InfluenzaA__AEK29136

SEQ ID NO: 37479 - RNA, 1701 nt, Artificial Sequence; identical to SEQ ID NO: 37477
  hemagglutinin__InfluenzaA__AEK29169

SEQ ID NO: 37480 - RNA, 1701 nt, Artificial Sequence; identical to SEQ ID NO: 37477
  hemagglutinin__InfluenzaA__AEK29180

SEQ ID NO: 37481 - RNA, 1701 nt, Artificial Sequence
  hemagglutinin__InfluenzaA__AEK29191
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37482 - RNA, 1701 nt, Artificial Sequence; identical to SEQ ID NO: 37481
  hemagglutinin__InfluenzaA__AEK29202

SEQ ID NO: 37483 - RNA, 1701 nt, Artificial Sequence; identical to SEQ ID NO: 37477
  hemagglutinin__InfluenzaA__AEK29213

SEQ ID NO: 37484 - RNA, 1701 nt, Artificial Sequence
  hemagglutinin__InfluenzaA__AEK29224
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaauuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37485 - RNA, 1701 nt, Artificial Sequence; identical to SEQ ID NO: 37481
  hemagglutinin__InfluenzaA__AEK29235

SEQ ID NO: 37486 - RNA, 1701 nt, Artificial Sequence
  hemagglutinin__InfluenzaA__AEK29268
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaaugugacuaugccaaacaaugaacaauuugacaaauuguacauuugggggguucaccacccggguacggacaaggaccaaaucuuccuguaugcucaagcaucaggaagaaucacaguaucuacaaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37487 - RNA, 1698 nt, Artificial Sequence
  hemagglutinin__InfluenzaA__AEK59838
augaaaguaaaacuacugguccuguuaugcacauuuacagcuacauaugcagacacaauauguauaggcuaccaugccaacaacucaaccgacacuguugacacaguacuugaaaagaaugugacagugacacacucugucaaccugcuugaggacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccagauccugagaauggaacauguuacccagggcauuucgcugacuaugaggaacugagggagcaauugaguucaguaucuucauuugagagguucgaaauauuccccaaagaaagcucauggcccaaccacaccguaaccggaguaucagcaucaugcucccauaaugggaaaagcaguuuuuacaaaaauuugcuauggcugacggggaagaaugguuuguacccaaaccugagcaaguccuaugcaaacaacaaagagaaagaaguccuuguacuaugggguguucaucacccgccaaacauaggugaccaaaaggcccucuaucauacagaaaaugcuuaugucucuguagugucuucacauuauagcaaaaaauucaccccagaaauagccaaaagacccaaaguaagagaucaagaaggaagaaucaacuacuacuggacucugcuugaacccgggaauacaauaauauuugaggcaaauggaaaucuaauagcgccaagauaugcuuucgcacugaguagaggcuuuggaucaggaaucaucaauucaaaugcaccaauggauaaaugugaugcgaagugccaaacaccucagggagcuauaaacagcagucuuccuuuccagaaugugcacccagucacaauaggagaguguccaaaguaugucaggagugcaaaauuaaggaugguuacaggacuaaggaacaucccauccauucaauccagagguuuguuuggagccauugccgguuucauugaaggaggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuuaaauaaaaaaguugaugauggguuuauagacauuuggacauacaaugcagaacuguugguucuacuggaaaaugaaaggacuuuggauuuccaugacuccaaugugaagaaucuguaugagaaaguaaaaagccaguuaaagaauaaugccaaagaaauaggaaaugggugcuuugaauucuaucacaaguguaacgaugaaugcauggagaguguaaaaaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuga

SEQ ID NO: 37488 - RNA, 1701 nt, Artificial Sequence
  hemagglutinin__InfluenzaA__AEK98378
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuucccguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacaaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccucgagaaauacguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37489 - RNA, 1701 nt, Artificial Sequence
  hemagglutinin__InfluenzaA__AEK98380
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacaaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccucgagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37490 - RNA, 1701 nt, Artificial Sequence
  hemagglutinin__InfluenzaA__AEK98382
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaauuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacugugaucccgaauaucggaucuagacccagaauaaggaauauccccagcagaauaagcaucuauuggacaauaguaaaaccgggagacauacuuuugauuaacagcacagggaaucuaauugcuccuagggguuacuucaaaauacaaauuggaaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccucgagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37491 - RNA, 1701 nt, Artificial Sequence
  hemagglutinin__InfluenzaA__AEK98386
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaagucacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagaaccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccucgagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37492 - RNA, 1701 nt, Artificial Sequence
  hemagglutinin__InfluenzaA__AEK98388
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuacaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37493 - RNA, 1701 nt, Artificial Sequence
  hemagglutinin__InfluenzaA__AEK98390
augaagacuaucauugcuuugagcuacauucuaugucugguuuucgcucaagaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauucuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuugaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagauauacuuuugauuaacagcacagggaaucuaauugcuccuagggguuacuucaaaauacgaagugggaaaagcucaauaaugagaucagaugcacccauuggcaaaugcaaaucugcaugcaucacuccaaauggaagcauucccaaugacaaaacauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguaugguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccucgagaaauacguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucgaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcucuguugggguucaucaugugggccugccaaaaaggcaacauuaggugcaacauuugcauuuga

SEQ ID NO: 37494 - RNA, 1701 nt, Artificial Sequence
  hemagglutinin__InfluenzaA__AEK98392
augaagacuaucauugcuuugagcuacauucuaugucugguuuucgcucaaaaacuuccuggaaaugacaacagcacggcaacgcugugccuugggcaccaugcagugccaaacggaacaauagugaaaacaaucacggaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaaacuucaauuggacuggagucacucaaaacggaacaagcucugcuugcauaaggagaucuaauaauaguuucuuuaguagauugaauugguugacccacuugaacuucaaauacccagcauugaacgugaccaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacucagaguaaggaauaucccuagcagaguaagcaucuauuggacaauaguaaaaccgggagauauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggauaacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcuaaauagauugaucgggaaaaccaacgagaaauuccaucagauugaaaaagaauucucagaagucgaagggagaauucaggaccucgagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37495 - RNA, 1701 nt, Artificial Sequence
  hemagglutinin__InfluenzaA__AEK98394
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaagucacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaguacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacucagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccucgagaaauauguugaggacacuaaaauagaucucuggucauacaaugcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37496 - RNA, 1701 nt, Artificial Sequence
  hemagglutinin__InfluenzaA__AEK98396
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccagauuaugccucccuuaggucacuaguugccucauccggcacacuggaguuuaacaaugaaagcuucaauuggacuggagucacucaaaacggaacaagcucugcuuguauaaggagaucuaauaaaaguuucuuuaguagauugaauugguugacccacuuaaaauucaaauacccagcauugaacgugacuaugccaaacaaugaacaauuugacaaauuguacauuugggggguucaccacccggguacggacaaugaccaaaucucccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucuaaaauuggcaacagggaugcgaaauguaccagagaaacaaacuagaggcauauuuggcgcaaucgcggguuucauagaaaaugguugggagggaaugguggaugguugguacgguuucaggcaucaaaauucugaaggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccucgagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccuguauaggaucaaucagaaaugggacuuaugaccacgauguauacagagaugaagcauuaaacaaccgauuccagaucaagggaguugaguugaagucaggguacaaagauuggauccuauggaucuccuuugccauaucauguuuuuugcuuuguauugcuuuguugggguucaucaugugggccugccaaaaaggcaacauuaggugcaacauuugcauuuga

SEQ ID NO: 37497 - RNA, 1701 nt, Artificial Sequence
  hemagglutinin__InfluenzaA__AEK98398
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuacaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauauaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggaucauauggauuuccuuugccauaucauguuuuuugcuuuguguugcuuuguugggguucaucaugugggccugccaaaaaggcaacauuaggugcaacauuugcauuuga

SEQ ID NO: 37498 - RNA, 1701 nt, Artificial Sequence
  hemagglutinin__InfluenzaA__AEK98400
auggagacuaucauugcuuugagcuacauucuaagucugguuuucgcucaaaaacuuccuggaaaugacaacagcacggcaacgcugugccuugggcaccaugcaguaccaaacgggacgauagugaagacaaucacgaacgaccaaauugaaguuacuaaugcuacugagcugguucagaguuccucaacaggugaaauaugcgacaguccucaucagauccuugauggagaaaacugcacacuaauagaugcucuauugggagacccucagugugauggcuuucaaaauaagaaaugggaccuuuuuguugaacgcagcaaagccuacagcaacuguuacccuuaugaugugccggauuaugccucccuuaggucacuaguugccucauccggcacacuggaguuuaacaaugaaaacuucaauuggacuggagucacucaaaacggaacaagcucugcuugcauaaggagaucuaauaacaguuucuuuaguagauugaauugguugacccacuuaagauucaaauacccagcauugaacgugaccaugccaaacaaugaagaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaguucugaaugcaucacuccaaauggaagcaucccuaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaaaucgaagggagaauucaggaccucgagaaauauguugaggacaccaaaauagaucucuggucauacaacgcggagcuucuuguugcccuggagaaccaacauacaauugaucuaacugauucagaaaugaacaaacuguuugaaaaaacaaagaagcaacugagggaaaaugcugaggauaugggcaaugguuguuucaagaucuaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37499 - RNA, 1701 nt, Artificial Sequence
  hemagglutinin__InfluenzaA__AEK98402
augaagacuaucauugcuuugagcuacauucuaugucuggguuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucaaucaaaucaaugggaagcugaauagauugaucgggaaaaccaacgagaaauuccaucagauugaaaaagaauucucagaagucgaagggagaauucaggaccucgagaaauacguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37500 - RNA, 1701 nt, Artificial Sequence
  hemagglutinin__InfluenzaA__AEK98404
augaagacuaucauugcuuugagcuacauucuaagucugguuuucgcucaaaaacuuccuggaaaugacaacagcacggcaacgcugugccuugggcaccaugcaguaccaaacgggacgauagugaaaacaaucacgaacgaccaaauugaaguuacuaaugcuacugagcugguccagaguuccucaacaggugaaauaugugacaguccucaucagauccuugauggagaaaacugcacacuaauagaugcucuauugggagacccucagugugauggcuuccaaaauaagaaaugggaccuuuuuguugaacgcagcaaagcuuacagcaacuguuacccuuaugauguuccggauuaugccucccuuaggucacuaguugccucauccggcacacuggaguuuaacaaugaaaacuucaauuggacuggagucacucaaaacggaacaagcucugcuugcauaaggagaucuaauaacaguuucuuuaguagauugaauugguugacccacuuaagauucaaauacccagcauugaacgugacuaugccaaacaaugaagaauuugacaaauuguacauuuggggaguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccaggagacauacuuuugauuaacagcacagggaaucuaauugcuccuagggguuacuucaaaaugcgaagugggaaaagcucaauaaugagaucagaugcacccauuggcaaaugcaauucugaaugcaucacuccaaauggaagcauccccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcugcaaucgaucaaaucaaugggaagcugaauagguugauugggaaaaccaacgagaaauuccaucagauugaaaaagaauucucagaagucgaagggagaauucaggaccuugagaaauacguugaggacaccaaaauagaucucuggucauacaacgcggagcuucuuguugcccuggagaaccaacauacaauugaucuaacugauucagaaaugaacaaacuguuugaaaaaacaaagaagcaacugagggaaaaugcugaggauaugggcaaugguuguuucaaaaucuaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 37501 - RNA, 1701 nt, Artificial Sequence
  hemagglutinin__InfluenzaA__AEK98406
augaagacuaucauugcuuugagcuacauucuaagucugguuuucgcucaaaaacuuccuggaaaugacaacagcacggcaacgcugugccuugggcaccaugcaguaccaaacgggacgauagugaaaacaaucacgaacgaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaaacuucaauuggacuggagucacucaaaacggaacaagcucugcuugcauaaggagaucuaauaacaguuucuuuaguagauugaauugguugacccacuuaagauucaaauacccagcauugaacgugacuaugccaaacaaugaagaauuagacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauccccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccucgagaaauauguugaggacaccaaaauagaucucuggucauacaacgcggagcuucuuguugcccuggagaaccaacauacaauugaucuaacugauucagaaaugaacaaacuguuugaaaaaacaaagaagcaacugagggaaaaugcugaggauaugggcaaugguuguuucaaaaucuaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucgucaugugggccugccaaaaaggcaacauuaggugcaacauuugcauuuga

SEQ ID NO: 37502 - RNA, 1701 nt, Artificial Sequence
  hemagglutinin__InfluenzaA__AEL11687
augaagacuaucauugcuuugagcuacauucuaugucugguuuucgcccaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugauguaccggauuaugccucccuuaggucacuaguugccucauccggcacacuggaguuuaacaaugaaagcuucaauuggacuggagucacucaaaauggaacaagcucuucuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccgguuacggacaaugaccaaaucagacuauaugcucaagcuucaggaagaaucacagucucuaccaaaagaagccaacaaacuguaaucccgaauaucggauauagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaaacugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguuguuuuguugggguucaucaugugggccugccaaaaaggcaacauuaggugcaacauuugcauuuga

SEQ ID NO: 37503 - RNA, 1692 nt, Artificial Sequence
  hemagglutinin__InfluenzaA__AEL31632
auggagaaaauagugcuucuucuugcaauagucagucuuguuaaaagugaucagauuugcauugguuaccaugcaaacaacucgacagagcagguugacacaauaauggaaaagaacgucacuguuacacacgcccaagacauacuggaaaagacacacaacgggaaacucugcaaucuagauggagugaagccucuaauuuuaagagauuguagcguagccggauggcuccucgggaacccaaugugcgacgaauuccucaaugugccggaauggucuuacauaguggagaagaucaauccagccaaugaccucuguuauccagggaauuucaacgacuaugaagaacugaaacaccuauugagcagaauaaaccauuuugagaaaauucagaucauccccaaaaguucuuggucagaucaugaagccucaggagugagcucaguauguccauaccagggaagauccuccuuuuuuagaaaugugguauggcuuaccaaaaaggacaaugcauacccaacaauaaagagaaguuacaauaauaccaaccaagaagaucuuuugguacuaugggggauucaccauccaaaugaugcggcagagcagacaaggcuuuaucaaaacccaacuaccuauauuuccguugggacaucaacacuaaaccagagauugguaccaaaaauagcuacuagaucuaagguaaacgggcaaaguggaaggauggaguucuuuuggacaauuuuaaaaucgaaugaugcaauaaacuuugagaguaauggaaauuucauugcuccagaaaaugcauacaaaauugucaagaaaggggacucaacaauuaugaaaagugaguuggaauaugguaacugcaacaccaagugucagacuccaauaggggcgauaaacuccaguaugccauuccacaacauccacccucucaccaucggggaaugccccaaauaugugaaaucaaacagauuaguccuugcuacugggcuaagaaauagcccucaaggagagacgcgaggacuauuuggagcuauagcagguuuuauagagggaggauggcagggaaugguagaugguugguauggguaccaccauagcaacgagcaggggaguggguacgcugcagacaaagaauccacucaaaaggcaauagauggagucaccaauaaggucaacucaaucauugacaaaaugaacacucaguuugaggcuguuggaagggaauuuaauaacuuagaaaggagaauagaaaauuuaaacaagaagauggaagacggauuccuagaugucuggacuuauaaugcugaacuucugguucucauggaaaaugagagaacucuagacuuucaugacucaaaugucaagaaccuuuacgacaagguccggcuacagcuuagggauaaugcaaaggagcuugguaacgguuguuucgaguucuaucacagaugugauaaugaauguauggaaaguguaagaaacggaacguaugacuacccgcaguauucagaagaagcaagauuaaaaagagaggaaauaaguggaguaaaauuggagucaauaggaacuuaccaaauacugucaauuuauucaacaguggcgagcucccuagcacuggcaaucaugguggcuggucuauuuuuauggaugugcuccaauggaucguuacaaugcagaauuugcauuuaa

SEQ ID NO: 37504 - RNA, 1701 nt, Artificial Sequence; identical to SEQ ID NO: 37424
  hemagglutinin__InfluenzaA__AEL89297

SEQ ID NO: 37505 - RNA, 1701 nt, Artificial Sequence
  hemagglutinin__InfluenzaA__AEL89307
augaaggcaauacuaguaguucugcuauauacauuagcaaccgcaaaugcagacacauuauguauagguuaucaugcgaacaauucaacagacacuguagacacaguacuagaaaagaauguaacaguaacacacucuguuaaccuucuagaagacaagcaugacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaagagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaaugcaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguaggcaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37506 - RNA, 1701 nt, Artificial Sequence; identical to SEQ ID NO: 37425
  hemagglutinin__InfluenzaA__AEL89317

SEQ ID NO: 37507 - RNA, 1701 nt, Artificial Sequence; identical to SEQ ID NO: 37425
  hemagglutinin__InfluenzaA__AEL89327

SEQ ID NO: 37508 - RNA, 1701 nt, Artificial Sequence; identical to SEQ ID NO: 37425
  hemagglutinin__InfluenzaA__AEL89337

SEQ ID NO: 37509 - RNA, 1701 nt, Artificial Sequence; identical to SEQ ID NO: 37425
  hemagglutinin__InfluenzaA__AEL89347

SEQ ID NO: 37510 - RNA, 1701 nt, Artificial Sequence; identical to SEQ ID NO: 37425
  hemagglutinin__InfluenzaA__AEL89357

SEQ ID NO: 37511 - RNA, 1701 nt, Artificial Sequence; identical to SEQ ID NO: 37425
  hemagglutinin__InfluenzaA__AEL89367

SEQ ID NO: 37512 - RNA, 1701 nt, Artificial Sequence; identical to SEQ ID NO: 37424
  hemagglutinin__InfluenzaA__AEL89391

SEQ ID NO: 37513 - RNA, 1701 nt, Artificial Sequence; identical to SEQ ID NO: 37425
  hemagglutinin__InfluenzaA__AEL89401

SEQ ID NO: 37514 - RNA, 1701 nt, Artificial Sequence; identical to SEQ ID NO: 37425
  hemagglutinin__InfluenzaA__AEL89411

SEQ ID NO: 37515 - RNA, 1701 nt, Artificial Sequence; identical to SEQ ID NO: 37425
  hemagglutinin__InfluenzaA__AEL89421

SEQ ID NO: 37516 - RNA, 1701 nt, Artificial Sequence; identical to SEQ ID NO: 37425
  hemagglutinin__InfluenzaA__AEL89441

SEQ ID NO: 37517 - RNA, 1701 nt, Artificial Sequence; identical to SEQ ID NO: 37425
  hemagglutinin__InfluenzaA__AEL89451

SEQ ID NO: 37518 - RNA, 1701 nt, Artificial Sequence; identical to SEQ ID NO: 37425
  hemagglutinin__InfluenzaA__AEL89461

SEQ ID NO: 37519 - RNA, 1701 nt, Artificial Sequence; identical to SEQ ID NO: 37425
  hemagglutinin__InfluenzaA__AEL89471

SEQ ID NO: 37520 - RNA, 1701 nt, Artificial Sequence
  hemagglutinin__InfluenzaA__AEL89481
augaagguaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37521 - RNA, 1701 nt, Artificial Sequence; identical to SEQ ID NO: 37382
  hemagglutinin__InfluenzaA__AEL89491

SEQ ID NO: 37522 - RNA, 1701 nt, Artificial Sequence
  hemagglutinin__InfluenzaA__AEL89501
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacaucgcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccgaucaugacucgaacaaagguguaacggcagcauguccucaugcuggagcaaaaagcuucuacaaaaauuuaauauggcuaguuaaaaaaggaaauucauacccaaagcucagcaaauccuacauuaaugaugaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaaacuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37523 - RNA, 1701 nt, Artificial Sequence
  hemagglutinin__InfluenzaA__AEL89511
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacaucgcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaguuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37524 - RNA, 1701 nt, Artificial Sequence; identical to SEQ ID NO: 37398
  hemagglutinin__InfluenzaA__AEL89521

SEQ ID NO: 37525 - RNA, 1701 nt, Artificial Sequence
  hemagglutinin__InfluenzaA__AEL89531
augaaggcaauacuaguaguucugcuauauacauuuacaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugccaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauguuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugcugguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37526 - RNA, 1701 nt, Artificial Sequence
  hemagglutinin__InfluenzaA__AEL89541
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacaucgcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccgaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaaccuuggacuaccacgauucaaaugugaagaacuuauaugaaaagguaagaagccaguuaaaaaacaaugccaaggaaauuggaaacggcugcuuugaguuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37527 - RNA, 1701 nt, Artificial Sequence
  hemagglutinin__InfluenzaA__AEL89551
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacaucgcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccgaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccagcccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaguuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37528 - RNA, 1701 nt, Artificial Sequence
  hemagglutinin__InfluenzaA__AEL89561
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaauuaugcaaacuaagagggguagccccauugcauuuggguaaauguaacauugcuggcuggauccugggaaauccagagugugaaucacucuccacagcaagcucaugguccuacauuguggaaacaucuaguucaggcaauggaacguguuacccaggagauuucaucgauuaugaggagcuaagagaacaauugagcucagugucaucauuugaaagguuugagauauuccccaagacaaguucauggcccgaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaaggaaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacgccaguccacgauugcaauacaacuugucagacacccaagggugcuauaaacaccagccucccauuucagaauauacauccgaucacaaucggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaagggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuguuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacagagauuuaccagauuuuggcgaucuauucaacugucgccaguucauugguacugguagucucccugggggcaaucaguuucuggaugugcucuaaugggucucuacaguguagaauauguauuuaa

SEQ ID NO: 37529 - RNA, 1701 nt, Artificial Sequence
  hemagglutinin__InfluenzaA__AEL89571
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacaucgcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccgaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccaggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaguuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37530 - RNA, 1701 nt, Artificial Sequence
  hemagglutinin__InfluenzaA__AEL89581
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacaucgcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauguuccccaagacaaguucauggcccgaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaguuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37531 - RNA, 1701 nt, Artificial Sequence
  hemagglutinin__InfluenzaA__AEL89591
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 37532 - RNA, 1701 nt, Artificial Sequence
  hemagglutinin__InfluenzaA__AEL89601
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacgacagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaccuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaacauacauccgaucacaauuggaaaauguccaaaauauguaaaaagcacaaaauugagacuggccacaggauugaggaaugucccguccauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaaaaugaauacacaguucacagcaguagguaaagaguucaaccaccuggaaaaaagaauagagaauuuaaauaaaaaaguugaugaugguuuccuggacauuuggacuuacaaugccgagcuguugguucuauuggaaaaugaaagaacuuuggacuaccacgauucaaaggugaagaacuuauaugaaaagguaagaagccaguuaaaaaacaaugccaaggaaauuggaaacggcugcuuugaauuuuaccacaaaugugauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37533 - RNA, 1701 nt, Artificial Sequence; identical to SEQ ID NO: 37531
  hemagglutinin__InfluenzaA__AEL89611

SEQ ID NO: 37534 - RNA, 1701 nt, Artificial Sequence
  hemagglutinin__InfluenzaA__AEL89621
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugacaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuuuuggaugugcucuaaugggucucuacaguguagaauauguauuuaa

SEQ ID NO: 37535 - RNA, 1701 nt, Artificial Sequence
  hemagglutinin__InfluenzaA__AEL89631
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaauuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagggaacaauugagcucagugucaucauuugaaagguuugagauauuccccaagacaaguucauggcccgaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaucaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37536 - RNA, 1701 nt, Artificial Sequence
  hemagglutinin__InfluenzaA__AEL89641
augaaggcaauacuaguaguucugcuauauacauuagcaaccgcaaaugcagacacauuauguauagguuaucaugcgaacaauucaacagacacuguagacacaguacuagaaaagaauguaacaguaacacacucuguuaaccuucuagaagacaagcaugacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaagagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaaugcaacuugucagacacccaagggagcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguaugguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37537 - RNA, 1701 nt, Artificial Sequence
  hemagglutinin__InfluenzaA__AEL89651
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggaguuuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauuuguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37538 - RNA, 1701 nt, Artificial Sequence
  hemagglutinin__InfluenzaA__AEL89661
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 37539 - RNA, 1701 nt, Artificial Sequence
  hemagglutinin__InfluenzaA__AEL89671
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagagugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 37540 - RNA, 1701 nt, Artificial Sequence; identical to SEQ ID NO: 36942
  hemagglutinin__InfluenzaA__AEL89691

SEQ ID NO: 37541 - RNA, 1701 nt, Artificial Sequence
  hemagglutinin__InfluenzaA__AEL89701
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacgacagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaccuacuagugcugaccaacaaaaucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagcugaccugaagagcacacagaaugccauugacgggauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugugauaacacgugcauggaaagugucaaaaaugggacuuaugacuacccaaaauacucagaggaagcaaaauuaaacagagaagaaauagaugggguaaagcuggaaucaacaaugauuuaccagauuuuggcgaucuauucaacugucgccaguucauugguacugguagucucccugggggcaaucaguuucuggaugugcucuaaugggucucuacaguguagaauauguauuuaa

SEQ ID NO: 37542 - RNA, 1701 nt, Artificial Sequence; identical to SEQ ID NO: 37541
  hemagglutinin__InfluenzaA__AEL89711

SEQ ID NO: 37543 - RNA, 1701 nt, Artificial Sequence
  hemagglutinin__InfluenzaA__AEL89721
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuuuauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 37544 - RNA, 1701 nt, Artificial Sequence
  hemagglutinin__InfluenzaA__AEL89741
augaaggcaauacuaguaguucugcuauauacauuugcaaccacaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagauggaguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 37545 - RNA, 1701 nt, Artificial Sequence
  hemagglutinin__InfluenzaA__AEL89751
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaauuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagaacaauugagcucagugucaucauuugaaagguuugagauauuccccaagacaaguucauggcccgaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuaguggugccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37546 - RNA, 1701 nt, Artificial Sequence
  hemagglutinin__InfluenzaA__AEL89761
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacgacagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaccuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgggauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugugauaacacgugcauggaaagugucaaaaaugggacuuaugacuacccaaaauacucagaggaagcaaaauuaaacagagaagaaauagaugggguaaagcuggaaucaacaaugauuuaccagauuuuggcgaucuauucaacugucgccaguucauugguacugguagucucccugggggcaaucaguuucuggaugugcucuaaugggucucuacaguguagaauauguauuuaa

SEQ ID NO: 37547 - RNA, 1701 nt, Artificial Sequence
  hemagglutinin__InfluenzaA__AEL89771
augaaggcaauacuaguaguucugcuauauacauuagcaaccgcaaaugcagacacauuauguauagguuaucaugcgaacaauucaacagacacuguagacacaguacuagaaaagaauguaacaguaacacacucuguuaaccuucuagaagacaagcaugacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaagagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaaugcaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37548 - RNA, 1701 nt, Artificial Sequence
  hemagglutinin__InfluenzaA__AEL89781
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucaaacaaagguguaacgacagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaccuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgggauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugugauaacacgugcauggaaagugucaaaaaugggacuuaugacuacccaaaauacucagaggaagcaaaauuaaacagagaagaaauagaugggguaaagcuggaaucaacaaugauuuaccagauuuuggcgaucuauucaacugucgccaguucauugguacugguagucucccugggggcaaucaguuucuggaugugcucuaaugggucucuacaguguagaauauguauuuaa

SEQ ID NO: 37549 - RNA, 1701 nt, Artificial Sequence; identical to SEQ ID NO: 36942
  hemagglutinin__InfluenzaA__AEL89791

SEQ ID NO: 37550 - RNA, 1701 nt, Artificial Sequence
  hemagglutinin__InfluenzaA__AEL89801
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggaguuuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagaugcauauguuuuuguggggacaucaagauacagcaagaaguucaagccggaaauagcaguaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuguuuggggccauugccggcuucauugaagggggguggacagggaugguagauggaugguacgguuaucaccaucaaaaugagcaggggucaggauaugcagccgaccugaagagcacacagaaugccaucgacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuauccaaaauacucagaggaagcaaaauuaaacagagaagaaauagaugggguaaagcuggaaucaacaaggauuuaccagauuuuggcgaucuauucaacugucgccaguucauugauacugguagucucccugggggcaaucaguuucuggaugugcucuaaugggucucuacaguguagaauauguauuuaa

SEQ ID NO: 37551 - RNA, 1701 nt, Artificial Sequence
  hemagglutinin__InfluenzaA__AEL89812
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacgacagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaccuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaaugcaacuugucagacacccaaggguguuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgggauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugugauaacacgugcauggaaagugucaaaaaugggacuuaugacuacccaaaauacucagaggaagcaaaauuaaacagagaagaaauagaugggguaaagcuggaaucaacaaugauuuaccagauuuuggcgaucuauucaacugucgccaguucauugguacugguagucucccugggggcaaucaguuucuggaugugcucuaaugggucucuacaguguagaauauguauuuaa

SEQ ID NO: 37552 - RNA, 1701 nt, Artificial Sequence; identical to SEQ ID NO: 37538
  hemagglutinin__InfluenzaA__AEL89832

SEQ ID NO: 37553 - RNA, 1701 nt, Artificial Sequence
  hemagglutinin__InfluenzaA__AEL89842
augaaggcaauacuaguaguucugcuauauacauuagcaaccgcaaaugcagacacauuauguauagguuaucaugcgaacaauucaacagacacuguagacacaguacuagaaaagaauguaacaguaacacacucuguuaaccuucuagaagacaagcaugacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaagaguuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucggguauuaucauuucagauacaccaguccacgauugcaaugcaacuugucagacacccaagggugcuauaaacaccagccucccauuucagaauguacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuacuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37554 - RNA, 1701 nt, Artificial Sequence
  hemagglutinin__InfluenzaA__AEL89852
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacugagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaacgauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaguaagacccaaagugagggaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaaaaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37555 - RNA, 1701 nt, Artificial Sequence
  hemagglutinin__InfluenzaA__AEL93568
augaaggcaauacuaguaguucugcuauauacauuugcaaccgcaaaugcagacacauuauguauagguuaccaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaaaacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 37556 - RNA, 1701 nt, Artificial Sequence
  hemagglutinin__InfluenzaA__AEL93578
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucguugguacugguagucucccugggggcaaucaguuuuuggaugugcucuaaugggucucuacaguguagaauauguauuuaa

SEQ ID NO: 37557 - RNA, 1701 nt, Artificial Sequence
  hemagglutinin__InfluenzaA__AEL93598
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggaguuuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagaguacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggaugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37558 - RNA, 1701 nt, Artificial Sequence
  hemagglutinin__InfluenzaA__AEL93618
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcaugcccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 37559 - RNA, 1701 nt, Artificial Sequence; identical to SEQ ID NO: 36942
  hemagglutinin__InfluenzaA__AEL93628

SEQ ID NO: 37560 - RNA, 1701 nt, Artificial Sequence; identical to SEQ ID NO: 37374
  hemagglutinin__InfluenzaA__AEL93638

SEQ ID NO: 37561 - RNA, 1701 nt, Artificial Sequence
  hemagglutinin__InfluenzaA__AEL94870
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacaucgcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccgaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccagcccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauuaaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaguuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37562 - RNA, 1701 nt, Artificial Sequence
  hemagglutinin__InfluenzaA__AEL95426
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaacaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 37563 - RNA, 1701 nt, Artificial Sequence
  hemagglutinin__InfluenzaA__AEL97631
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuuaaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaacucauacccaaagcucagcaaauccuacauuaaugauaaagggaaagaaguccucgugcuauggggcauucaccauccaucuacuagugcugaccaacaaagccucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaccacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccaugauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37564 - RNA, 1701 nt, Artificial Sequence
  hemagglutinin__InfluenzaA__AEL99664
augaaagcaauacuaguaguucugcuauauacauuugcaaccgcaaaugcagacacauuauguauagguuaucaugcgaacaauucaacagacacuguagacacaauacuagaaaagaauguaacaguaacacauucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggaacuaagagagcaauugagcucagugucaucauuuaaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaucaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37565 - RNA, 1701 nt, Artificial Sequence
  hemagglutinin__InfluenzaA__AEL99674
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggggcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugccgaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaauauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccuuccauuucagaauauacauccgaucacaauuggaaaauguccaaaauauguaaaaagcacaaaauugagacuggccacaggauugaggaaugucccgucuauucaaucuagaggccuauuuggggccaucgccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37566 - RNA, 1689 nt, Artificial Sequence
  hemagglutinin__InfluenzaA__AEM53455
auggccaucauuuaucucauucuccuguucacagcagugagaggggaccagauaugcauuggauaccaugccaauaauuccacagagaaggucgacacaauucuagagcggaacgucacugugacucaugccaaggacauucuugagaagacccauaacggaaaguuaugcaaacuaaacggaaucccuccacuugaacuaggggacuguagcauugccggauggcuccuuggaaauccagaaugugauaggcuucuaagugugccagaaugguccuauauaauggagaaagaaaacccgagagacgguuuguguuauccaggcagcuucaaugauuaugaagaauugaaacaucuccucagcagcgugaaacauuucgagaaaguaaagauucugcccaaagauagauggacacagcauacaacaacuggagguucacgggccugcgcggugucugguaauccaucauucuucaggaacauggucuggcugacaaagaaaggaucaaauuauccgguugccaaaggaucguacaacaauacaagcggagaacaaaugcuaauaauuuggggggugcaccaucccaaugaugagacagaacaaagaacauuguaccagaaugugggaaccuauguuuccguaggcacaucaacauugaacaaaaggucaaccccagacauagcaacaaggccuaaagugaauggacuaggagguagaauggaauucucuuggacccuauuggauaugugggacaccauaaauuuugagaguacugguaaucuaauugcaccagaguauggauucaaaauaucgaaaagagguaguucagggaucaugaaaacagaaggaacacuugggaacugugagaccaaaugccaaacuccuuugggagcaauaaauacaacauugccuuuucacaauguccacccacugacaauaggugagugccccaaauauguaaaaucggagaaguuggucuuagcaacaggacuaaggaauguuccccagauugaaucaagaggauuguuuggggcaauagcugguuuuauagaaggaggauggcaaggaaugguugaugguugguauggauaccaucacagcaaugaccagggaucaggguaugcagcggacaaagaauccacucaaaaggcauuugauggaaucaccaacaagguaaauucugugauugaaaagaugaacacccaauuugaagcuguugggaaagaauucaguaacuuagagagaagacuggagaacuugaacaaaaagauggaagacggguuucuagauguguggacauacaaugcugagcuucuaguucugauggaaaaugagaggacacuugacuuucaugauucuaaugucaagaaucuguaugauaaagucagaaugcagcugagagacaacgucaaagaacuaggaaauggauguuuugaauuuuaucacaaaugugaugaugaaugcaugaauagugugaaaaacgggacguaugauuaucccaaguaugaagaagagucuaaacuaaauagaaaugaaaucaaagggguaaaauugagcagcauggggguuuaucaaauccuugccauuuaugcuacaguagcagguucucugucacuggcaaucaugauggcugggaucucuuucuggaugugcuccaacgggucucugcagugcaggaucugcauauga

SEQ ID NO: 37567 - RNA, 1689 nt, Artificial Sequence; identical to SEQ ID NO: 32124
  hemagglutinin__InfluenzaA__AEM53468

SEQ ID NO: 37568 - RNA, 1698 nt, Artificial Sequence; identical to SEQ ID NO: 32619
  hemagglutinin__InfluenzaA__AEM60037

SEQ ID NO: 37569 - RNA, 1698 nt, Artificial Sequence
  hemagglutinin__InfluenzaA__AEM60058
augaaaguaaaacuacuuguucuguuauguacauuuacagcuacauaugcagacacaauauguauaggcuaccaugccaacaacucgacugacacuguugacacaguacuugagaagaaugugacagugacacacucugucaaccuacuugaggaaagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggauauuucgccgacuaugaggagcugagggagcaauugaguucaguaucuucauuugagagguucgaaauauuccccaaagagagcucauggcccaaucacaccguaaccggaguaucagcaucaugcucccauaacggggaaagcaguuuuuacagaaauuuguuauggcugacggggaagaaugguuuguauccaaaccugagcaaguccuaugcaaacaacaaagagaaagacguccuuguacugugggguguucaucacccgccuaacauaggagaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacuggguagaggcuuuggaucaggaaucaucaccucaaaugcaccaauggauaaaugugaugcgaagugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaauuuaaauaaaaagguugaugauggguuucuagacauuuggacauauaaugcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauucuggcgaucuacucaacagucgccaguuccuugguucuuuuggucucccugggggcaaucagcuucuggauguguuccaaugggucuuugcagugucgaauaugcaucuaa

SEQ ID NO: 37570 - RNA, 1701 nt, Artificial Sequence
  hemagglutinin__InfluenzaA__AEM60069
augaagacuaucauugcuuugagcuacauuuucugucugguuuucgcccaaaaacuucccggaaaugacaacagcacagcaacgcugugccugggacaucaugcagugccaaacggaacucuagugaaaacaaucacgaaugaucagauugaagugacuaaugcuacugagcugguucagaguuccucaacagguagaauaugcgacaguccucaccgaauccuugauggaaaaaacugcacacugauagaugcucuauugggagacccucauugugauggcuuccaaaaugagaaaugggaccuuuuuguugaacgcagcaaagcuuacagcaacuguuacccuuaugaugugccggauuaugccucccuuagaucacuaguugccucaucaggcacccuggaguuuaucaaugaagacuucaauuggacuggagucacucagagugggggaagcuaugcuugcaaaaggggaucuguuaaaaguuucuucaguagauugaauugguugcacgaaucagaauacaaauauccagcgcugaacgugacuaugccaaacaauggcaaauuugacaaauuguacauuugggggguucaccauccgagcacagacagagaacaaaccaaccuauauguucgagcaucagggagagucacagucucuaccaagagaagccagcaaacuguaaucccgaauaucgggucuagacccuggguaaggggucuguccaguagaauaagcaucuauuggacaauaguaaaaccgggagacauacuguugauuaauagcaccgggaaccuaauugcuccucgggguuacuucaaaauacgcacugggaaaagcucaauaaugaggucagaugcaccuauuggcaccugcagcucugaaugcaucacuccaaauggaagcauucccaaugacaaacccuuucaaaauguaaacaagaucacauauggggcaugucccagguauguuaagcaaaacacucugaaauuggcaacagggaugcggaauguaccagagaaacaaacuagaggcauauucggcgcaauagcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcccuggagaaccaacauacaauugaucugacugacucagaaaugaacaaacuguuugaaaaaacaaggaagcaacugagggaaaaugcugaggacaugggcaaugguugcuucaagauauaccacaaaugugacaaugccugcauagggucaaucagaaauggaacuuaugaccaugauguauacagagacgaagcauuaaacaaccgguuccagaucaaagguguugagcugaagucaggauacaaagacuggaucuuauggauuuccuuugccauaucaugcuuuuugcuuuguguuguuuugcugggguucaucaugugggccugccaaaaaggcaacauuaggugcaacauuugcauuuga

SEQ ID NO: 37571 - RNA, 1701 nt, Artificial Sequence
  hemagglutinin__InfluenzaA__AEM92308
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauuuggcuaguuaaaaaaagaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauuagacccaaagugagggaucaagaagggagaaugaacuauuacuggacacuaguagagccgggagacaaaauaacauucgaagcaacugaaaaucuagugguaccgagauaugcauucgcaauggaaagaaaugcuggaucugguauuaucauuucagauacaccaguccaugauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaguuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuucuggaugugcucuaaugggucucuacaguguagaauauguauuuaa

SEQ ID NO: 37572 - RNA, 1701 nt, Artificial Sequence
  hemagglutinin__InfluenzaA__AEM92318
augaaggcaauacuaguaguucugcuauauacauuugcgaccgcaaaugcagacacauuauguauagguuaucaugcgaacaauucaacagacacuguagacacaguacuagaaaagaauguaacaguaacacacucuguugaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugaaauauuccccaagacaaguucauggcccaaucaugacucgaacaaagguguaacggcagcauguccucaugcuggagaaaaaagcuucuacaaaaauuuaauauggcuaguuaaaaaaggaaauucauacccaaagcucaacaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguuuaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaauccacgauugcaauacaacuugucagacacccaagggggcuauaaacaccagccucccauuucagaauauacauccgaucacaauuggaaaguguccaaaauauguaaaaagcacaaaauugagacuggccacaggauugaggaaugucccgucuauucaaucuagaggccuauuuggggccauugccgguuucauugaagggggguggacaggaaugguagauggaugguacgguuaucaccaucaaaaugagcaggggucaggauaugcagccgaccugaagagcacacagaaugccauugacgagauuacuaacaaaguaaauucuguuauugaaaagaugaacacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37573 - RNA, 1701 nt, Artificial Sequence
  hemagglutinin__InfluenzaA__AEM92328
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucaacauauccuacauuaaugauaaagggaaagaaguccucgugcuauggggcauucaccauccaucuacuacugcugaccaacaaagucucuaucagaaugcagaugcauauguuuuuguggggacaucaagauacagcaagaaguucaagccggaaauagcaauaagacccaaaguaagggaucaagaagggagaaugaacuauuacuggacacuaguagagccuggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccaucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaacacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37574 - RNA, 1701 nt, Artificial Sequence
  hemagglutinin__InfluenzaA__AEM92348
augaaggcaauacuaguaguucugcuauauacauuugcgaccgcaaaugcagacacauuauguauagguuaucaugcgaacaauucaacagacacuguagacacaguacuagaaaagaauguaacaguaacacacucuguugaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugaaauauuccccaagacaaguucauggcccaaucaugacucgaacaaagguguaacggcagcauguccucaugcuggagaaaaaagcuucuacaaaaauuuaauauggcuaguuaaaaaaggaaauucauacccaaagcucaacaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguuuaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaauccacgauugcaauacaacuugucagacacccaagggggcuauaaacaccagccucccauuucagaauauacauccgaucacaauuggaaaguguccaaaauauguaaaaagcacaaaauugagacuggccacaggauugaggaaugucccgucuauucaaucuagaggccuauuuggggccauugccgguuucauugaagggggguggacaggaaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaaaaagccaguuaaaaaacaacgccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37575 - RNA, 1701 nt, Artificial Sequence
  hemagglutinin__InfluenzaA__AEM92358
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaagaaggaaauucauacccaaagcucagcaaauccuacauuaaugauaaagggaaagaaguccucgugcuauggggcauucaccauccaucuacuacuacugaccaacaaagucucuaucagaaugcagaugcauauguuuuuguggggacaucaagauacagcaagaaguucaagccggaaauagcaauaagacccaaaaugagggaucaagaagggagaaugaacuauuacuggacacuaguagagccgggagacaaaauaacauuugaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 37576 - RNA, 1701 nt, Artificial Sequence
  hemagglutinin__InfluenzaA__AEM92368
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucaacaaauccuacauuaaugauaaagggaaagaaguccucgugcuauggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccuggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccaucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaacacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37577 - RNA, 1701 nt, Artificial Sequence
  hemagglutinin__InfluenzaA__AEM92378
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugaacucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucaacaaauccuacauuaaugauaaagggaaagaaguccucgugcuauggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccuggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccaucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaacacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37578 - RNA, 1701 nt, Artificial Sequence
  hemagglutinin__InfluenzaA__AEM92407
augaaggcaauacuaguaguucugcuauauacauuugcaacugcaaaugcagacacauuaugcauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggaucuugggaaauccagagugugaaucacucuccacagcaaacucaugguccuacauuguggaaacauccaguucagacaauggaacguguuacccaggagauuucaucgauuaugaggagcuaagagagcaauugagcucagugucaucauucgaaagguuugagauauuccccaagacaaauucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaaggaaaagaaguccucgugcuauggggcauucaccauccaucuacuaguacugaccaacaaagucucuaucagaaugcagaugcauauguuuuuguggggacaucaagauacagcaagaaguuuaagccggaaauagcaauaagacccaaagugaggaaucaagaagggagaaugaacuauuacuggacacuaguagagccgggagacaaaauaacauucgaagcaacuggaaaucuagugguaccgagauaugcauucacaauugaaagaaaugcuggaucugguauuaucauuucagauacaccaauccacgauugcaauacaacuugucagacacccaagggggcuauaaacaccagccucccauuucagaauauacauccgaucacaauuggaaaguguccaaaauauguaaaaagcacaaaauugcgacuggccacaggauugaggaaugucccgucuauucaaucuagaggccuauuuggggccauugccgguuucauugaagggggguggacaggaaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguaggcaaagaguucaaccaccuggaaaaaagaauagagaauuuaaauaaaaaaguugaugaugguuuccuggacauuuggacucacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaugggaucucuacaguguagaauauguauuuaa

SEQ ID NO: 37579 - RNA, 1701 nt, Artificial Sequence
  hemagglutinin__InfluenzaA__AEM92417
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaaugcaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaaggcaaguucauggcccaaucaugacucgaacaaagguguaacggcagcauguccucaugcuggagcaaaaagcuucuacaaaaauuuaauauggcuaguuaaaaaagaaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37580 - RNA, 1701 nt, Artificial Sequence
  hemagglutinin__InfluenzaA__AEM92428
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggguucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacaugugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37581 - RNA, 1701 nt, Artificial Sequence
  hemagglutinin__InfluenzaA__AEM92438
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagauaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37582 - RNA, 1701 nt, Artificial Sequence
  hemagglutinin__InfluenzaA__AEM92448
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacugagagggguagccccauugcauuuggguaaauguaacauugcuggcuggauccugggaaauccagagugugaaucacucuccacagcaagcucaugguccuacaucguggaaacaucuaguucagacaauggaacgugcuacccaggagauuucaucaauuaugaggagcuaagagagcaauugagcucagugucaucauuugaaagguuugagauauuccccaagacaaguucauggcccaaucaugacucgaacaaagguguaacggcagcauguccucaagcuggagcaaaaagcuucuacaaaaauuuaauauggcuaguuaaaaaaggaaauucauacccaaagcucagcaaauccuacauuaacgauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaguaagacccaaagugagggaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaaugucccaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugcgcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaaaaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37583 - RNA, 1701 nt, Artificial Sequence; identical to SEQ ID NO: 37582
  hemagglutinin__InfluenzaA__AEM92458

SEQ ID NO: 37584 - RNA, 1701 nt, Artificial Sequence
  hemagglutinin__InfluenzaA__AEM92468
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacugagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaagagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaacgauaaagggaaagaaguccucgugcuauggggcauucaccauccaucuacuagugcugaccaacaaagucucuaucagaaugcagaugcauauguuuuuguggggacaucaaaauacagcaaggaguucaagccggaaauagcaguaagacccaaagugagggaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccaguccacgauugcaauacaauuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugcuauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaaaaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37585 - RNA, 1701 nt, Artificial Sequence
  hemagglutinin__InfluenzaA__AEM92478
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacugagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaagagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaacgauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaguaagacccaaagugagggaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccaguccacgauugcaauacaauuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugcuauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaaaaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37586 - RNA, 1701 nt, Artificial Sequence
  hemagglutinin__InfluenzaA__AEM92498
augaaggcaauacuaguaguucugcuauauacauuugcaacugcaaaugcagacacauuaugcauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggaucuugggaaauccagagugugaaucacucuccacagcaaacucaugguccuacauuguggaaacauccaguucagacaauggaacguguuacccaggagauuucaucgauuaugaggagcuaagagagcaauugagcucagugucaucauucgaaagguuugagauauuccccaagacaaauucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccagcccacgauugcaauacaacuugucagacacccaagggugcuauaaacaccagccucccauuucagaauauacauccgaucacaauuggaaaauguccaaaauauguaaaaagcaccaaauugagacuggccacaggauugaggaaugucccguccauucaaucuagaggccuauuuggggccauugccgguuucauugaagggggguggacagggaugguagauggaugguacgguuaccaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaaucuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37587 - RNA, 1701 nt, Artificial Sequence
  hemagglutinin__InfluenzaA__AEM92518
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacgacagcauguccucaugcuggagcaaaaagcuucuacaaaaauuuaauauggcuaguuaaaaaaggaaauucauacccaaagcucagcaaauccuacauuaaugauaaaaggaaagaaguccucgugcuauggggcauucaccauccaccuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaaugcaacuugucagacacccaagggugcuauaaacaccagccucccauuucagaacauacauccgaucacaauuggaaaauguccaaaauauguaaaaagcacaaaauugagacuggccacaggauugaggaaugucccguccauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaacucuguuauugaaaaaaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaggugaagaacuuauaugaaaagguaagaagccaguuaaaaaacaaugccaaggaaauuggaaacggcugcuuugaauuuuaccacaaaugugauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37588 - RNA, 1701 nt, Artificial Sequence
  hemagglutinin__InfluenzaA__AEM92528
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucaacaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauuugaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagcguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37589 - RNA, 1701 nt, Artificial Sequence
  hemagglutinin__InfluenzaA__AEM92548
augaaggcaauacuaguaguucugcuauauacauuugcaaccgcaacugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37590 - RNA, 1701 nt, Artificial Sequence
  hemagglutinin__InfluenzaA__AEM92558
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguagcauugcuggcuggauccugggaaauccagaaugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37591 - RNA, 1701 nt, Artificial Sequence; identical to SEQ ID NO: 37590
  hemagglutinin__InfluenzaA__AEM92568

SEQ ID NO: 37592 - RNA, 1701 nt, Artificial Sequence
  hemagglutinin__InfluenzaA__AEM92578
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuauuucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucaaaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccaugauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37593 - RNA, 1701 nt, Artificial Sequence
  hemagglutinin__InfluenzaA__AEM92608
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaccaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37594 - RNA, 1701 nt, Artificial Sequence
  hemagglutinin__InfluenzaA__AEM92618
augaaggcaauacuaguaguucugcuauauacauuugcaacugcaaaugcagacacauuaugcauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggaucuugggaaauccagagugugaaucacucuccacagcaaacucaugguccuacauuguggaaacauccaguucagacaauggaacguguuacccaggagauuucaucgauuaugaggagcuaagagagcaauugagcucagugucaucauucgaaagguuugagauauuccccaagacaaauucauggcccaaucaugacucgaacaaagguguaacggcagcauguccucaugcuggagcaaaaagcuucuacaaaaauuuaauauggcuaguuaaaacaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaggaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccagcccacgauugcaauacaacuugucagacacccaagggugcuauaaacaccagccucccauuucagaauauacauccgaucacaauuggaaaauguccaaaauauguaaaaagcaccaaauugagacuggccacaggauugaggaaugucccguccauucaaucuagaggccuauuuggggccauugccgguuucauugaagggggguggacagggaugguagauggaugguacgguuaccaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaaucuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37595 - RNA, 1701 nt, Artificial Sequence
  hemagglutinin__InfluenzaA__AEM92638
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucauugauuaugaggagcuaagagagcaauugagcucagugucaucauuugaaagguuugagauauuccccaaaacaaguucauggcccaaucaugacacgaacaaagguguaacggcagcauguccucaugcuggagcaaaaagcuucuacaaaaauuuaauuuggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaaaccggaaauagcaauuagacccaaagugagggaucaagaagggagaaugaacuauuacuggacacuaguagagccgggagacaaaauaacauucgaagcaacuggaaaucuagugguaccaagauaugcauucgcaauggaaaaaaaugcuggaucugguauuaucauuucagauacaccaguccaugauugcaauacaacuugucagacacccaagggugcuauaaacaccagccucccauuucagaauauacauccgauuacaauuggaaaauguccaaaauauguaaaaagcacaaaauugagacuggccacaggauugaggaaugucccgucuauucaaucuagaggucuauuuggggccauugcugguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggagaaugaaagaacuuuggacuaccacgauucaaaugugaagaacuuauaugaaaaaguaagaagccagcuaaaaaacaaugccaaggaaguuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuucuggaugugcucuaaugggucucuacaguguagaauauguauuuaa

SEQ ID NO: 37596 - RNA, 1701 nt, Artificial Sequence
  hemagglutinin__InfluenzaA__AEM92648
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucauugauuaugaggagcuaagagagcaauugagcucagugucaucauuugaaagguuugagauauuccccaaaacaaguucauggcccaaucaugacacgaacaaagguguaacggcagcauguccucaugcuggagcaaaaagcuucuacaaaaauuuaauuuggcuaguuaaagaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaaaccggaaauagcaauuagacccaaagugagggaucaagaagggagaaugaacuauuacuggacacuaguagagccgggagacaaaauaacauucgaagcaacuggaaaucuagugguaccaagauaugcauucgcaauggaaaaaaaugcuggaucugguauuaucauuucagauacaccaguccaugauugcaauacaacuugucagacacccaagggugcuauaaacaccagccucccauuucagaauauacauccgauuacaauuggaaaauguccaaaauauguaaaaagcacaaaauugagacuggccacaggauugaggaaugucccgucuauucaaucuagaggucuauuuggggccauugcugguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggagaaugaaagaacuuuggacuaccacgauucaaaugugaagaacuuauaugaaaaaguaagaagccagcuaaaaaacaaugccaaggaaguuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuucuggaugugcucuaaugggucucuacaguguagaauauguauuuaa

SEQ ID NO: 37597 - RNA, 1701 nt, Artificial Sequence; identical to SEQ ID NO: 36037
  hemagglutinin__InfluenzaA__AEM98407

SEQ ID NO: 37598 - RNA, 1701 nt, Artificial Sequence; identical to SEQ ID NO: 36548
  hemagglutinin__InfluenzaA__AEM98418

SEQ ID NO: 37599 - RNA, 1701 nt, Artificial Sequence; identical to SEQ ID NO: 36037
  hemagglutinin__InfluenzaA__AEM98429

SEQ ID NO: 37600 - RNA, 1701 nt, Artificial Sequence
  hemagglutinin__InfluenzaA__AEN55398
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaauuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggaaauuucaucgauuaugaggagcuaagagaacaauugagcucagugucaucauuugaaagguuugagauauuccccaagacaaguucauggcccgaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuaguggcaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggucacaggauugaggaaugucccgucuauucaaucuagaggccuauuuggggccauugccgguuucauugaagggggguggacagggaugguagauggaugguacgguuaucaccaucaaaaugagcaggggucuggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37601 - RNA, 1701 nt, Artificial Sequence; identical to SEQ ID NO: 37425
  hemagglutinin__InfluenzaA__AEN55408

SEQ ID NO: 37602 - RNA, 1701 nt, Artificial Sequence; identical to SEQ ID NO: 37538
  hemagglutinin__InfluenzaA__AEN55418

SEQ ID NO: 37603 - RNA, 1701 nt, Artificial Sequence
  hemagglutinin__InfluenzaA__AEN55463
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaauuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagaacaauugagcucagugucaucauuugaaagguuugagauauuccccaagacaaguucauggcccgaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguggauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaaaguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37604 - RNA, 1701 nt, Artificial Sequence
  hemagglutinin__InfluenzaA__AEN55473
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucauugauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacuacugaccaacaaagucucuaucagacugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaccaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 37605 - RNA, 1701 nt, Artificial Sequence; identical to SEQ ID NO: 37538
  hemagglutinin__InfluenzaA__AEN55483

SEQ ID NO: 37606 - RNA, 1701 nt, Artificial Sequence
  hemagglutinin__InfluenzaA__AEN55493
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacgacagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaccuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgggauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugugauaacacgugcauggaaagugucaaaaaugggacuuaugacuacccaaaauacucagaggaagcaaaauuaaacagagaagaaauagaugggguaaagcuggaaucaacaaugauuuaccagauuuuggcgaucuauucaacugucgccaguucauugguacugguagucucccugggggcaaucaguuucuggaugugcucuaaugggucucuacaguguagaauauguauuuaa

SEQ ID NO: 37607 - RNA, 1701 nt, Artificial Sequence; identical to SEQ ID NO: 37538
  hemagglutinin__InfluenzaA__AEN55503

SEQ ID NO: 37608 - RNA, 1701 nt, Artificial Sequence
  hemagglutinin__InfluenzaA__AEN55513
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaaaucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuuuauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 37609 - RNA, 1701 nt, Artificial Sequence
  hemagglutinin__InfluenzaA__AEN55523
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaauucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 37610 - RNA, 1701 nt, Artificial Sequence
  hemagglutinin__InfluenzaA__AEN68904
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaagggaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37611 - RNA, 1701 nt, Artificial Sequence; identical to SEQ ID NO: 33206
  hemagglutinin__InfluenzaA__AEN68905

SEQ ID NO: 37612 - RNA, 1701 nt, Artificial Sequence
  hemagglutinin__InfluenzaA__AEN68906
augaaggcaauacuaguaguucugcuauauacauuugcaacagcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaggaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37613 - RNA, 1701 nt, Artificial Sequence
  hemagglutinin__InfluenzaA__AEN68907
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucaggcaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaacucauacccaaagcucagcaaauccuacauuaaugauaaagggaaagaaguccucgugcuauggggcauucaccauccgucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37614 - RNA, 1701 nt, Artificial Sequence; identical to SEQ ID NO: 33206
  hemagglutinin__InfluenzaA__AEN68908

SEQ ID NO: 37615 - RNA, 1701 nt, Artificial Sequence
  hemagglutinin__InfluenzaA__AEN68909
augaaggcaauacuaguaguucugcuauauacauuugcaaccgcaaaugcagacacauuauguguagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuacuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaaguacaaaauugagacuggccacaggauugaggaaugucccgucuauucaaucuagaggccuauuuggggccauugccgguuucauugaagggggguggacagggaugguagauggaugguacgguuaucaccaucaaaaugagcagggaucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37616 - RNA, 1701 nt, Artificial Sequence
  hemagglutinin__InfluenzaA__AEN68910
augaaggcaauacuaguaguucugcuauauacauuugcaaccgcaaaugcagacacauuauguguagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuacuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaagguacaaaauugagacuggccacaggauugaggaaugucccgucuauucaaucuagaggccuauuuggggccauugccgguuucauugaagggggguggacagggaugguagauggaugguacgguuaucaccaucaaaaugagcagggaucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37617 - RNA, 1701 nt, Artificial Sequence
  hemagglutinin__InfluenzaA__AEN68911
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaaucuuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagagaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaauugaugaugguuuccuggauauuuggacuuacaaugccgaacuguugguucuauuggaaaaugaaagaacuuuggacuaccacgauucaaaugugaagaacuuguaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37618 - RNA, 1701 nt, Artificial Sequence
  hemagglutinin__InfluenzaA__AEN68912
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauauccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37619 - RNA, 1701 nt, Artificial Sequence
  hemagglutinin__InfluenzaA__AEN68913
augaaggcaauacuaguaguucugcuauauacauuugcaaccgcaaaugcagacacauuauguauagguuaucaugcgaacaauucaacagacacuguagacacaguacuggaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaauugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37620 - RNA, 1701 nt, Artificial Sequence
  hemagglutinin__InfluenzaA__AEN68914
augaaggcaauacuaguaguucugcuauauacauuugcaaccgcaaaugcagacacauuauguauagguuaucaugcgaacaauucaacagacacuguagacacaguacuggaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagggagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacaaaaugccauugacgagauuacuaacaaaguaaauucuguuauugaaaagaugaauacacaguucacagcaguagguaaagaguucaaccaccuggaaaaaagaauagagaauuuaaauaaaaaaauugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37621 - RNA, 1701 nt, Artificial Sequence; identical to SEQ ID NO: 36378
  hemagglutinin__InfluenzaA__AEN68915

SEQ ID NO: 37622 - RNA, 1701 nt, Artificial Sequence
  hemagglutinin__InfluenzaA__AEN68916
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuugugggaacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37623 - RNA, 1701 nt, Artificial Sequence
  hemagglutinin__InfluenzaA__AEN68917
augaaggcaauacuaggaguucugcuauauacauuugcaaccgcaaacgcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaguccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauuugaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccggucacaauuggaaaauguccaaaauauguaaaaagcacaaaauugagacuggccacaggauugaggaaugucccgucuauucaaucuagaggccuauuuggggccauugccgguuucauugaagggggguggacaggaaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacgaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37624 - RNA, 1701 nt, Artificial Sequence
  hemagglutinin__InfluenzaA__AEN68918
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagaauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacauguuacccaggagauuucaucgauuaugaggagcuaagagagcaauugagcucagugucaucauuugaaagguuugagauguuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccauccacuagugcugaccaacaaagucuauaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauacgcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaguuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37625 - RNA, 1701 nt, Artificial Sequence
  hemagglutinin__InfluenzaA__AEN68919
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacaucgcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccgaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37626 - RNA, 1701 nt, Artificial Sequence
  hemagglutinin__InfluenzaA__AEN68920
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacauguuacccaggagauuucaucgauuaugaggagcuaagagagcaauugagcucagugucaucauuugaaagguuugagauguuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccauccacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauacgcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaguuggaaacggcugcuuugaauuuuaccacaaaugcgauaacacaugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37627 - RNA, 1701 nt, Artificial Sequence
  hemagglutinin__InfluenzaA__AEN68921
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauauagcaagaaguucaagccggaaauagcaauaagacccaaagugagggaucaagaagggagaaugaacuacuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccuaaauacucagaggaagcaaaauuaaacagagaagaaauagauggggugaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37628 - RNA, 1701 nt, Artificial Sequence
  hemagglutinin__InfluenzaA__AEN68922
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacauguuacccaggagauuucaucgauuaugaggagcuaagagagcaauugagcucagugucaucauuugaaagguuugagauguuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauauagcaagaaguucaagccggaaauagcaauaagacccaaagugagggaucaagaagggagaaugaacuacuacuggacacuaguagagccgggagacaaaauaacauucgaagcaacuggaaaucuagugguaccgagauacgcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccuaaauacucagaggaagcaaaauuaaacagagaagaaauagauggggugaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37629 - RNA, 1701 nt, Artificial Sequence; identical to SEQ ID NO: 37627
  hemagglutinin__InfluenzaA__AEN68923

SEQ ID NO: 37630 - RNA, 1701 nt, Artificial Sequence; identical to SEQ ID NO: 37627
  hemagglutinin__InfluenzaA__AEN68924

SEQ ID NO: 37631 - RNA, 1701 nt, Artificial Sequence
  hemagglutinin__InfluenzaA__AEN68925
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggagacaucaagauauagcaagaaguucaagccggaaauagcaauaagacccaaagugagggaucaagaagggagaaugaacuacuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaccaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccuaaauacucagaggaagcaaaauuaaacagagaagaaauagauggggugaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37632 - RNA, 1701 nt, Artificial Sequence
  hemagglutinin__InfluenzaA__AEN68926
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucgccacagcaagcucaugguccuacauaguggaaacaucuaauucagacaauggaacguguuacccaggagauuucaucgauuaugaggagcuaagagagcaguugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggagagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccuucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguugaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37633 - RNA, 1701 nt, Artificial Sequence
  hemagglutinin__InfluenzaA__AEN68927
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaauuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagaacaauugagcucagugucaucauuugaaagguuugagauauuccccaagacaaguucauggcccgaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37634 - RNA, 1701 nt, Artificial Sequence
  hemagglutinin__InfluenzaA__AEN68928
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucguggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauauagcaagaaguucaagccggaaauagcaauaagacccaaagugagggaucaagaagggagaaugaacuacuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauaaaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37635 - RNA, 1701 nt, Artificial Sequence
  hemagglutinin__InfluenzaA__AEN68929
augaaggcaauacuaguaguucugcuauauacauuugcaaccgcaaacgcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggauagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaguccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauuugaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucugucauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37636 - RNA, 1701 nt, Artificial Sequence
  hemagglutinin__InfluenzaA__AEN68930
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaauuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagaacaauugagcucagugucaucauuugaaagguuugagauauuccccaagacaaguucauggcccgaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37637 - RNA, 1701 nt, Artificial Sequence
  hemagglutinin__InfluenzaA__AEN68931
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaauuaugcaaacuaagagggguagccccauugcauuuggguaaauguaacauugcuggcuggauccugggaaauccagagugugaaucacucuccacagcaagcucgugguccuacauuguggaaacaucuaguucagacaauggaacguguuacccaggagauuucaucgauuaugaggagcuaagagaacaauugagcucagugucaucauuugaaagguuugagauauuccccaagacaaguucauggcccgaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37638 - RNA, 1701 nt, Artificial Sequence; identical to SEQ ID NO: 37636
  hemagglutinin__InfluenzaA__AEN68932

SEQ ID NO: 37639 - RNA, 1701 nt, Artificial Sequence
  hemagglutinin__InfluenzaA__AEN69426
augaaggcaauacuaguaguucugcuauauacauuugcaaccucaaaugcagacacauuauguauagguuaucaugcgaacaauucaacagacacuguagacacaguacuagaaaagaauguaacaguaacacacucuguuaaccuucuagaagacaagcauaacgggaaauuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggaaauuucaucgauuaugaggagcuaagagaacaauugagcucagugucaucauuugaaagguuugagauauuccccaagacaaguucauggcccgaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuaguggcaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauuaaggaaugucccgucuauucaaucuagaggccuauuuggggccauugccgguuucauugaagggggguggacagggaugguagauggaugguacgguuaucaccaucaaaaugagcaggggucuggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37640 - RNA, 1701 nt, Artificial Sequence
  hemagglutinin__InfluenzaA__AEN69475
augaaggcaauacuaguaguucugcuauauacauuagcaaccgcaaaugcagacacauuauguauagguuaucaugcgaacaauucaacagacacuguagacacaguacuagaaaagaauguaacaguaacacacucuguuaaccuucuagaagacaagcaugacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaagagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaaugcaacuugucagacacccaagggugcuauaaacaccagccucccauuucagaauauacauccgaucacaauuggaaaauguccaaaauauguaaaaagcacaaaauugagacuggccacaggguugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuacuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37641 - RNA, 1701 nt, Artificial Sequence; identical to SEQ ID NO: 37425
  hemagglutinin__InfluenzaA__AEN69481

SEQ ID NO: 37642 - RNA, 1701 nt, Artificial Sequence; identical to SEQ ID NO: 33426
  hemagglutinin__InfluenzaA__AEO01032

SEQ ID NO: 37643 - RNA, 1701 nt, Artificial Sequence; identical to SEQ ID NO: 34264
  hemagglutinin__InfluenzaA__AEO01033

SEQ ID NO: 37644 - RNA, 1701 nt, Artificial Sequence; identical to SEQ ID NO: 34264
  hemagglutinin__InfluenzaA__AEO01034

SEQ ID NO: 37645 - RNA, 1701 nt, Artificial Sequence; identical to SEQ ID NO: 33168
  hemagglutinin__InfluenzaA__AEO01035

SEQ ID NO: 37646 - RNA, 1701 nt, Artificial Sequence; identical to SEQ ID NO: 34264
  hemagglutinin__InfluenzaA__AEO01036

SEQ ID NO: 37647 - RNA, 1701 nt, Artificial Sequence; identical to SEQ ID NO: 33457
  hemagglutinin__InfluenzaA__AEO01037

SEQ ID NO: 37648 - RNA, 1701 nt, Artificial Sequence; identical to SEQ ID NO: 34264
  hemagglutinin__InfluenzaA__AEO01038

SEQ ID NO: 37649 - RNA, 1701 nt, Artificial Sequence; identical to SEQ ID NO: 33390
  hemagglutinin__InfluenzaA__AEO01039

SEQ ID NO: 37650 - RNA, 1701 nt, Artificial Sequence
  hemagglutinin__InfluenzaA__AEO01040
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaagggaauucauacccaaagcucagcaaauccuacauuaaugauaaagggaaaaaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaauagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37651 - RNA, 1701 nt, Artificial Sequence; identical to SEQ ID NO: 33173
  hemagglutinin__InfluenzaA__AEO01041

SEQ ID NO: 37652 - RNA, 1701 nt, Artificial Sequence; identical to SEQ ID NO: 34264
  hemagglutinin__InfluenzaA__AEO01042

SEQ ID NO: 37653 - RNA, 1701 nt, Artificial Sequence
  hemagglutinin__InfluenzaA__AEO01043
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucaaacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacacccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagcagaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37654 - RNA, 1701 nt, Artificial Sequence
  hemagglutinin__InfluenzaA__AEO01044
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacauguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccagaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37655 - RNA, 1701 nt, Artificial Sequence
  hemagglutinin__InfluenzaA__AEO01045
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaaucuagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaaaagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucggaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37656 - RNA, 1701 nt, Artificial Sequence; identical to SEQ ID NO: 33206
  hemagglutinin__InfluenzaA__AEO01046

SEQ ID NO: 37657 - RNA, 1701 nt, Artificial Sequence; identical to SEQ ID NO: 33206
  hemagglutinin__InfluenzaA__AEO01047

SEQ ID NO: 37658 - RNA, 1701 nt, Artificial Sequence
  hemagglutinin__InfluenzaA__AEO01048
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacauguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccagaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguaaaauauguauuuaa

SEQ ID NO: 37659 - RNA, 1701 nt, Artificial Sequence; identical to SEQ ID NO: 34071
  hemagglutinin__InfluenzaA__AEO01049

SEQ ID NO: 37660 - RNA, 1701 nt, Artificial Sequence; identical to SEQ ID NO: 33206
  hemagglutinin__InfluenzaA__AEO01050

SEQ ID NO: 37661 - RNA, 1701 nt, Artificial Sequence; identical to SEQ ID NO: 34264
  hemagglutinin__InfluenzaA__AEO01051

SEQ ID NO: 37662 - RNA, 1701 nt, Artificial Sequence
  hemagglutinin__InfluenzaA__AEO01052
augaaggcaauaauaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugagagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37663 - RNA, 1701 nt, Artificial Sequence; identical to SEQ ID NO: 34845
  hemagglutinin__InfluenzaA__AEO01053

SEQ ID NO: 37664 - RNA, 1701 nt, Artificial Sequence; identical to SEQ ID NO: 33173
  hemagglutinin__InfluenzaA__AEO01054

SEQ ID NO: 37665 - RNA, 1701 nt, Artificial Sequence
  hemagglutinin__InfluenzaA__AEO01055
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacaacaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37666 - RNA, 1701 nt, Artificial Sequence; identical to SEQ ID NO: 34264
  hemagglutinin__InfluenzaA__AEO01056

SEQ ID NO: 37667 - RNA, 1701 nt, Artificial Sequence
  hemagglutinin__InfluenzaA__AEO01057
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaaaagcacacagaaugccauugacgagauuacuaacaaaguaaauucuguuauugaaaagaugaauacacaguucacagcaguagguaaagaguucaaccaccuggaaaaaagaauagagaaucuaaauaaaaaaguugaugaugguuuccuggacauuuggacuuacaaugccgaacuauugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37668 - RNA, 1701 nt, Artificial Sequence
  hemagglutinin__InfluenzaA__AEO01058
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaaaaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37669 - RNA, 1701 nt, Artificial Sequence
  hemagglutinin__InfluenzaA__AEO01059
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagacggaugguacgguuaucaccaucaaaaugagcaggggucaggauaugcagccgaccugaaaagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuauugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37670 - RNA, 1701 nt, Artificial Sequence
  hemagglutinin__InfluenzaA__AEO01060
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuauguaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaaaagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37671 - RNA, 1701 nt, Artificial Sequence
  hemagglutinin__InfluenzaA__AEO01061
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgagcuguugguucuauuggaaaaugaaagaacuuuggauuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37672 - RNA, 1701 nt, Artificial Sequence
  hemagglutinin__InfluenzaA__AEO01062
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaaaagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37673 - RNA, 1701 nt, Artificial Sequence
  hemagglutinin__InfluenzaA__AEO01063
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucguguuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37674 - RNA, 1701 nt, Artificial Sequence
  hemagglutinin__InfluenzaA__AEO01064
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaaaagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuauugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37675 - RNA, 1701 nt, Artificial Sequence; identical to SEQ ID NO: 33457
  hemagglutinin__InfluenzaA__AEO01065

SEQ ID NO: 37676 - RNA, 1701 nt, Artificial Sequence
  hemagglutinin__InfluenzaA__AEO01066
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaucauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37677 - RNA, 1701 nt, Artificial Sequence
  hemagglutinin__InfluenzaA__AEO01067
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauggcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37678 - RNA, 1701 nt, Artificial Sequence; identical to SEQ ID NO: 34264
  hemagglutinin__InfluenzaA__AEO01068

SEQ ID NO: 37679 - RNA, 1701 nt, Artificial Sequence; identical to SEQ ID NO: 33801
  hemagglutinin__InfluenzaA__AEO01069

SEQ ID NO: 37680 - RNA, 1701 nt, Artificial Sequence; identical to SEQ ID NO: 34264
  hemagglutinin__InfluenzaA__AEO01070

SEQ ID NO: 37681 - RNA, 1701 nt, Artificial Sequence; identical to SEQ ID NO: 35174
  hemagglutinin__InfluenzaA__AEO01071

SEQ ID NO: 37682 - RNA, 1701 nt, Artificial Sequence
  hemagglutinin__InfluenzaA__AEO01073
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccuaggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuguaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37683 - RNA, 1701 nt, Artificial Sequence; identical to SEQ ID NO: 33457
  hemagglutinin__InfluenzaA__AEO01074

SEQ ID NO: 37684 - RNA, 1701 nt, Artificial Sequence; identical to SEQ ID NO: 34264
  hemagglutinin__InfluenzaA__AEO01075

SEQ ID NO: 37685 - RNA, 1701 nt, Artificial Sequence; identical to SEQ ID NO: 34264
  hemagglutinin__InfluenzaA__AEO01076

SEQ ID NO: 37686 - RNA, 1701 nt, Artificial Sequence
  hemagglutinin__InfluenzaA__AEO01077
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccuagugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaaaugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37687 - RNA, 1701 nt, Artificial Sequence; identical to SEQ ID NO: 33173
  hemagglutinin__InfluenzaA__AEO01078

SEQ ID NO: 37688 - RNA, 1701 nt, Artificial Sequence
  hemagglutinin__InfluenzaA__AEO01079
augaaggcaauacuaguaguucugcuauauacauuugcaaccgcaaaugcagacacauuauguauagguuaucaugcaaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37689 - RNA, 1701 nt, Artificial Sequence; identical to SEQ ID NO: 33206
  hemagglutinin__InfluenzaA__AEO01080

SEQ ID NO: 37690 - RNA, 1701 nt, Artificial Sequence; identical to SEQ ID NO: 34264
  hemagglutinin__InfluenzaA__AEO01081

SEQ ID NO: 37691 - RNA, 1701 nt, Artificial Sequence; identical to SEQ ID NO: 37688
  hemagglutinin__InfluenzaA__AEO01082

SEQ ID NO: 37692 - RNA, 1701 nt, Artificial Sequence; identical to SEQ ID NO: 33206
  hemagglutinin__InfluenzaA__AEO01083

SEQ ID NO: 37693 - RNA, 1701 nt, Artificial Sequence
  hemagglutinin__InfluenzaA__AEO01084
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuuuuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucguguuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37694 - RNA, 1701 nt, Artificial Sequence; identical to SEQ ID NO: 34264
  hemagglutinin__InfluenzaA__AEO01085

SEQ ID NO: 37695 - RNA, 1701 nt, Artificial Sequence
  hemagglutinin__InfluenzaA__AEO01086
augaaggcaauacuaguaguucugcuauauacauuugcaaccgcaaaugcugacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37696 - RNA, 1701 nt, Artificial Sequence
  hemagglutinin__InfluenzaA__AEO01087
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugccagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37697 - RNA, 1701 nt, Artificial Sequence; identical to SEQ ID NO: 33390
  hemagglutinin__InfluenzaA__AEO01088

SEQ ID NO: 37698 - RNA, 1701 nt, Artificial Sequence; identical to SEQ ID NO: 34264
  hemagglutinin__InfluenzaA__AEO01089

SEQ ID NO: 37699 - RNA, 1701 nt, Artificial Sequence
  hemagglutinin__InfluenzaA__AEO01090
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacuggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37700 - RNA, 1701 nt, Artificial Sequence; identical to SEQ ID NO: 34264
  hemagglutinin__InfluenzaA__AEO01091

SEQ ID NO: 37701 - RNA, 1701 nt, Artificial Sequence
  hemagglutinin__InfluenzaA__AEO01092
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaggguaagaagccaguuaaaaaacaaugccaaggaaauuggaaacggcugcuuugaauuuuaccacaaaugcgacaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37702 - RNA, 1701 nt, Artificial Sequence; identical to SEQ ID NO: 33206
  hemagglutinin__InfluenzaA__AEO01093

SEQ ID NO: 37703 - RNA, 1701 nt, Artificial Sequence
  hemagglutinin__InfluenzaA__AEO01094
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauuaaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggauuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37704 - RNA, 1701 nt, Artificial Sequence; identical to SEQ ID NO: 36421
  hemagglutinin__InfluenzaA__AEO01095

SEQ ID NO: 37705 - RNA, 1701 nt, Artificial Sequence; identical to SEQ ID NO: 34264
  hemagglutinin__InfluenzaA__AEO01096

SEQ ID NO: 37706 - RNA, 1701 nt, Artificial Sequence; identical to SEQ ID NO: 34264
  hemagglutinin__InfluenzaA__AEO01097

SEQ ID NO: 37707 - RNA, 1701 nt, Artificial Sequence; identical to SEQ ID NO: 34264
  hemagglutinin__InfluenzaA__AEO01098

SEQ ID NO: 37708 - RNA, 1701 nt, Artificial Sequence; identical to SEQ ID NO: 33206
  hemagglutinin__InfluenzaA__AEO01099

SEQ ID NO: 37709 - RNA, 1701 nt, Artificial Sequence; identical to SEQ ID NO: 33457
  hemagglutinin__InfluenzaA__AEO01100

SEQ ID NO: 37710 - RNA, 1701 nt, Artificial Sequence; identical to SEQ ID NO: 33206
  hemagglutinin__InfluenzaA__AEO01101

SEQ ID NO: 37711 - RNA, 1701 nt, Artificial Sequence
  hemagglutinin__InfluenzaA__AEO01102
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuagaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37712 - RNA, 1701 nt, Artificial Sequence
  hemagglutinin__InfluenzaA__AEO01103
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuauaauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccacuuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37713 - RNA, 1701 nt, Artificial Sequence; identical to SEQ ID NO: 34264
  hemagglutinin__InfluenzaA__AEO01104

SEQ ID NO: 37714 - RNA, 1701 nt, Artificial Sequence
  hemagglutinin__InfluenzaA__AEO01105
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgagcaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauuaguacugguagucucccugggggcaaucaguuucuggaugugcucuaaugggucucuacaguguagaauauguauuuaa

SEQ ID NO: 37715 - RNA, 1701 nt, Artificial Sequence
  hemagglutinin__InfluenzaA__AEO01106
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaaguuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37716 - RNA, 1701 nt, Artificial Sequence; identical to SEQ ID NO: 33206
  hemagglutinin__InfluenzaA__AEO01107

SEQ ID NO: 37717 - RNA, 1701 nt, Artificial Sequence; identical to SEQ ID NO: 33206
  hemagglutinin__InfluenzaA__AEO01108

SEQ ID NO: 37718 - RNA, 1701 nt, Artificial Sequence
  hemagglutinin__InfluenzaA__AEO01109
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucguguuauggggcauucaccauccaucuacuagugcugaccaacaaagucucuaucagaaugcagaugcauauguuuuuguggggacaucaagauacagcaagaaguucaagccggagauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37719 - RNA, 1701 nt, Artificial Sequence; identical to SEQ ID NO: 37672
  hemagglutinin__InfluenzaA__AEO01110

SEQ ID NO: 37720 - RNA, 1701 nt, Artificial Sequence; identical to SEQ ID NO: 33173
  hemagglutinin__InfluenzaA__AEO01111

SEQ ID NO: 37721 - RNA, 1701 nt, Artificial Sequence; identical to SEQ ID NO: 37673
  hemagglutinin__InfluenzaA__AEO01112

SEQ ID NO: 37722 - RNA, 1701 nt, Artificial Sequence
  hemagglutinin__InfluenzaA__AEO01113
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcaugucuucaugcuggagcaaaaagcuucuacaaaaauuuaauauggcuaguuaaaaaaggaaauucauacccaaagcucagcaaauccuacauuaaugauaaagggaaagaaguccucguguuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37723 - RNA, 1701 nt, Artificial Sequence; identical to SEQ ID NO: 33457
  hemagglutinin__InfluenzaA__AEO01114

SEQ ID NO: 37724 - RNA, 1701 nt, Artificial Sequence
  hemagglutinin__InfluenzaA__AEO01115
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcaugucuucaugcuggagcaaaaagcuucuacaaaaauuuaauauggcuaguuaaaaaaggaaauucauacccaaagcucagcaaauccuacauuaaugauaaagggaaagaaguccucguguuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37725 - RNA, 1701 nt, Artificial Sequence; identical to SEQ ID NO: 37674
  hemagglutinin__InfluenzaA__AEO01116

SEQ ID NO: 37726 - RNA, 1701 nt, Artificial Sequence; identical to SEQ ID NO: 37674
  hemagglutinin__InfluenzaA__AEO01117

SEQ ID NO: 37727 - RNA, 1701 nt, Artificial Sequence; identical to SEQ ID NO: 34039
  hemagglutinin__InfluenzaA__AEO01118

SEQ ID NO: 37728 - RNA, 1701 nt, Artificial Sequence; identical to SEQ ID NO: 37674
  hemagglutinin__InfluenzaA__AEO01119

SEQ ID NO: 37729 - RNA, 1701 nt, Artificial Sequence
  hemagglutinin__InfluenzaA__AEO01120
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacguuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37730 - RNA, 1701 nt, Artificial Sequence; identical to SEQ ID NO: 33173
  hemagglutinin__InfluenzaA__AEO01121

SEQ ID NO: 37731 - RNA, 1701 nt, Artificial Sequence; identical to SEQ ID NO: 34264
  hemagglutinin__InfluenzaA__AEO01122

SEQ ID NO: 37732 - RNA, 1701 nt, Artificial Sequence; identical to SEQ ID NO: 33173
  hemagglutinin__InfluenzaA__AEO01123

SEQ ID NO: 37733 - RNA, 1701 nt, Artificial Sequence
  hemagglutinin__InfluenzaA__AEO01124
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuuuuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaauaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37734 - RNA, 1701 nt, Artificial Sequence; identical to SEQ ID NO: 34264
  hemagglutinin__InfluenzaA__AEO01125

SEQ ID NO: 37735 - RNA, 1701 nt, Artificial Sequence
  hemagglutinin__InfluenzaA__AEO01126
augaaggcaacacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37736 - RNA, 1701 nt, Artificial Sequence; identical to SEQ ID NO: 33173
  hemagglutinin__InfluenzaA__AEO01127

SEQ ID NO: 37737 - RNA, 1701 nt, Artificial Sequence
  hemagglutinin__InfluenzaA__AEO01128
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuagguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37738 - RNA, 1701 nt, Artificial Sequence; identical to SEQ ID NO: 37712
  hemagglutinin__InfluenzaA__AEO01129

SEQ ID NO: 37739 - RNA, 1701 nt, Artificial Sequence
  hemagglutinin__InfluenzaA__AEO01130
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcaugcccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaaaccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggaugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37740 - RNA, 1701 nt, Artificial Sequence
  hemagglutinin__InfluenzaA__AEO01131
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaaaagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37741 - RNA, 1701 nt, Artificial Sequence; identical to SEQ ID NO: 33206
  hemagglutinin__InfluenzaA__AEO01132

SEQ ID NO: 37742 - RNA, 1701 nt, Artificial Sequence
  hemagglutinin__InfluenzaA__AEO01133
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccuucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaugauuuaccagauuuuggcgaucuauucaacugucgccaguucauugguacugguagucucccugggggcaaucaguuucuggaugugcucuaaugggucucuacaguguagaauauguauuuaa

SEQ ID NO: 37743 - RNA, 1701 nt, Artificial Sequence; identical to SEQ ID NO: 34264
  hemagglutinin__InfluenzaA__AEO01134

SEQ ID NO: 37744 - RNA, 1701 nt, Artificial Sequence; identical to SEQ ID NO: 34264
  hemagglutinin__InfluenzaA__AEO01135

SEQ ID NO: 37745 - RNA, 1701 nt, Artificial Sequence
  hemagglutinin__InfluenzaA__AEO01136
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugaaauauuccccaagacgaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaaaagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuauugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37746 - RNA, 1701 nt, Artificial Sequence; identical to SEQ ID NO: 33620
  hemagglutinin__InfluenzaA__AEO01137

SEQ ID NO: 37747 - RNA, 1701 nt, Artificial Sequence; identical to SEQ ID NO: 33620
  hemagglutinin__InfluenzaA__AEO01138

SEQ ID NO: 37748 - RNA, 1701 nt, Artificial Sequence
  hemagglutinin__InfluenzaA__AEO01139
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccuggguaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37749 - RNA, 1701 nt, Artificial Sequence; identical to SEQ ID NO: 33173
  hemagglutinin__InfluenzaA__AEO01140

SEQ ID NO: 37750 - RNA, 1701 nt, Artificial Sequence; identical to SEQ ID NO: 33206
  hemagglutinin__InfluenzaA__AEO01141

SEQ ID NO: 37751 - RNA, 1701 nt, Artificial Sequence; identical to SEQ ID NO: 33173
  hemagglutinin__InfluenzaA__AEO01142

SEQ ID NO: 37752 - RNA, 1701 nt, Artificial Sequence
  hemagglutinin__InfluenzaA__AEO01144
augaaggcaauacuaguaguucugcuauauacauuugcaaccgcaaaugcagacacauuauguauagguuaucaugcuaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuauuucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37753 - RNA, 1701 nt, Artificial Sequence
  hemagglutinin__InfluenzaA__AEO01145
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccuucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37754 - RNA, 1701 nt, Artificial Sequence
  hemagglutinin__InfluenzaA__AEO01146
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaauccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37755 - RNA, 1701 nt, Artificial Sequence; identical to SEQ ID NO: 33206
  hemagglutinin__InfluenzaA__AEO01147

SEQ ID NO: 37756 - RNA, 1701 nt, Artificial Sequence; identical to SEQ ID NO: 34264
  hemagglutinin__InfluenzaA__AEO01148

SEQ ID NO: 37757 - RNA, 1701 nt, Artificial Sequence
  hemagglutinin__InfluenzaA__AEO01149
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucucgaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37758 - RNA, 1701 nt, Artificial Sequence; identical to SEQ ID NO: 36421
  hemagglutinin__InfluenzaA__AEO01150

SEQ ID NO: 37759 - RNA, 1701 nt, Artificial Sequence; identical to SEQ ID NO: 33206
  hemagglutinin__InfluenzaA__AEO01151

SEQ ID NO: 37760 - RNA, 1701 nt, Artificial Sequence
  hemagglutinin__InfluenzaA__AEO01152
augaaggcaauacuaauaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugaggggacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37761 - RNA, 1701 nt, Artificial Sequence
  hemagglutinin__InfluenzaA__AEO01153
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaauaauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucaaauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaaccuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37762 - RNA, 1701 nt, Artificial Sequence; identical to SEQ ID NO: 33206
  hemagglutinin__InfluenzaA__AEO01154

SEQ ID NO: 37763 - RNA, 1701 nt, Artificial Sequence; identical to SEQ ID NO: 34264
  hemagglutinin__InfluenzaA__AEO01155

SEQ ID NO: 37764 - RNA, 1701 nt, Artificial Sequence; identical to SEQ ID NO: 34264
  hemagglutinin__InfluenzaA__AEO01156

SEQ ID NO: 37765 - RNA, 1701 nt, Artificial Sequence
  hemagglutinin__InfluenzaA__AEO01157
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccccaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37766 - RNA, 1701 nt, Artificial Sequence; identical to SEQ ID NO: 33206
  hemagglutinin__InfluenzaA__AEO01158

SEQ ID NO: 37767 - RNA, 1701 nt, Artificial Sequence; identical to SEQ ID NO: 33800
  hemagglutinin__InfluenzaA__AEO01159

SEQ ID NO: 37768 - RNA, 1701 nt, Artificial Sequence
  hemagglutinin__InfluenzaA__AEO01160
augaaggcaauacuaguagcucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37769 - RNA, 1701 nt, Artificial Sequence; identical to SEQ ID NO: 33173
  hemagglutinin__InfluenzaA__AEO01161

SEQ ID NO: 37770 - RNA, 1701 nt, Artificial Sequence; identical to SEQ ID NO: 34264
  hemagglutinin__InfluenzaA__AEO01162

SEQ ID NO: 37771 - RNA, 1701 nt, Artificial Sequence; identical to SEQ ID NO: 34264
  hemagglutinin__InfluenzaA__AEO01163

SEQ ID NO: 37772 - RNA, 1701 nt, Artificial Sequence; identical to SEQ ID NO: 37757
  hemagglutinin__InfluenzaA__AEO01164

SEQ ID NO: 37773 - RNA, 1701 nt, Artificial Sequence
  hemagglutinin__InfluenzaA__AEO01165
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguugaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaaguucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcgguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37774 - RNA, 1701 nt, Artificial Sequence; identical to SEQ ID NO: 34264
  hemagglutinin__InfluenzaA__AEO01166

SEQ ID NO: 37775 - RNA, 1701 nt, Artificial Sequence
  hemagglutinin__InfluenzaA__AEO01167
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaucaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37776 - RNA, 1701 nt, Artificial Sequence; identical to SEQ ID NO: 33206
  hemagglutinin__InfluenzaA__AEO01168

SEQ ID NO: 37777 - RNA, 1701 nt, Artificial Sequence; identical to SEQ ID NO: 34264
  hemagglutinin__InfluenzaA__AEO01169

SEQ ID NO: 37778 - RNA, 1701 nt, Artificial Sequence
  hemagglutinin__InfluenzaA__AEO01170
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuucuuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37779 - RNA, 1701 nt, Artificial Sequence
  hemagglutinin__InfluenzaA__AEO01171
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaaccugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37780 - RNA, 1701 nt, Artificial Sequence
  hemagglutinin__InfluenzaA__AEO01172
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccuugugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37781 - RNA, 1701 nt, Artificial Sequence
  hemagglutinin__InfluenzaA__AEO01173
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagcuccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggaggcaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggguaugcagccgaccugaagagcacacagaaugccauugacgagauuacuaacaaaguaaauucuguuauugaaaagaugaauacacaguucacagcaguagguaaagaauucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37782 - RNA, 1701 nt, Artificial Sequence
  hemagglutinin__InfluenzaA__AEO01174
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucaggcaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37783 - RNA, 1701 nt, Artificial Sequence; identical to SEQ ID NO: 33173
  hemagglutinin__InfluenzaA__AEO01176

SEQ ID NO: 37784 - RNA, 1701 nt, Artificial Sequence; identical to SEQ ID NO: 33173
  hemagglutinin__InfluenzaA__AEO01177

SEQ ID NO: 37785 - RNA, 1701 nt, Artificial Sequence
  hemagglutinin__InfluenzaA__AEO01179
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugaggcuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37786 - RNA, 1701 nt, Artificial Sequence; identical to SEQ ID NO: 37757
  hemagglutinin__InfluenzaA__AEO01180

SEQ ID NO: 37787 - RNA, 1701 nt, Artificial Sequence; identical to SEQ ID NO: 37785
  hemagglutinin__InfluenzaA__AEO01181

SEQ ID NO: 37788 - RNA, 1701 nt, Artificial Sequence; identical to SEQ ID NO: 34264
  hemagglutinin__InfluenzaA__AEO01182

SEQ ID NO: 37789 - RNA, 1701 nt, Artificial Sequence; identical to SEQ ID NO: 33173
  hemagglutinin__InfluenzaA__AEO01183

SEQ ID NO: 37790 - RNA, 1701 nt, Artificial Sequence
  hemagglutinin__InfluenzaA__AEO01184
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacagcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37791 - RNA, 1701 nt, Artificial Sequence; identical to SEQ ID NO: 37673
  hemagglutinin__InfluenzaA__AEO01185

SEQ ID NO: 37792 - RNA, 1701 nt, Artificial Sequence; identical to SEQ ID NO: 37673
  hemagglutinin__InfluenzaA__AEO01186

SEQ ID NO: 37793 - RNA, 1701 nt, Artificial Sequence; identical to SEQ ID NO: 37673
  hemagglutinin__InfluenzaA__AEO01187

SEQ ID NO: 37794 - RNA, 1701 nt, Artificial Sequence; identical to SEQ ID NO: 37672
  hemagglutinin__InfluenzaA__AEO01188

SEQ ID NO: 37795 - RNA, 1701 nt, Artificial Sequence; identical to SEQ ID NO: 37673
  hemagglutinin__InfluenzaA__AEO01189

SEQ ID NO: 37796 - RNA, 1701 nt, Artificial Sequence; identical to SEQ ID NO: 37674
  hemagglutinin__InfluenzaA__AEO01191

SEQ ID NO: 37797 - RNA, 1701 nt, Artificial Sequence; identical to SEQ ID NO: 33173
  hemagglutinin__InfluenzaA__AEO01192

SEQ ID NO: 37798 - RNA, 1701 nt, Artificial Sequence
  hemagglutinin__InfluenzaA__AEO01193
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaagggaauucauacccaaagcucagcaaauccuacauuaaugauaaagggaaagaaguccucgugcuauggggcauucaccauccaucuacuaaugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37799 - RNA, 1701 nt, Artificial Sequence; identical to SEQ ID NO: 34264
  hemagglutinin__InfluenzaA__AEO01194

SEQ ID NO: 37800 - RNA, 1701 nt, Artificial Sequence; identical to SEQ ID NO: 34264
  hemagglutinin__InfluenzaA__AEO01195

SEQ ID NO: 37801 - RNA, 1701 nt, Artificial Sequence
  hemagglutinin__InfluenzaA__AEO01196
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaaaacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37802 - RNA, 1701 nt, Artificial Sequence; identical to SEQ ID NO: 33206
  hemagglutinin__InfluenzaA__AEO01197

SEQ ID NO: 37803 - RNA, 1701 nt, Artificial Sequence; identical to SEQ ID NO: 33659
  hemagglutinin__InfluenzaA__AEO01198

SEQ ID NO: 37804 - RNA, 1701 nt, Artificial Sequence
  hemagglutinin__InfluenzaA__AEO01200
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggaaauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauacgaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37805 - RNA, 1701 nt, Artificial Sequence
  hemagglutinin__InfluenzaA__AEO01201
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagaaaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuguuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuga

SEQ ID NO: 37806 - RNA, 1701 nt, Artificial Sequence
  hemagglutinin__InfluenzaA__AEO01202
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucguacuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37807 - RNA, 1701 nt, Artificial Sequence
  hemagglutinin__InfluenzaA__AEO01203
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37808 - RNA, 1701 nt, Artificial Sequence; identical to SEQ ID NO: 33206
  hemagglutinin__InfluenzaA__AEO01204

SEQ ID NO: 37809 - RNA, 1701 nt, Artificial Sequence; identical to SEQ ID NO: 33206
  hemagglutinin__InfluenzaA__AEO01205

SEQ ID NO: 37810 - RNA, 1701 nt, Artificial Sequence; identical to SEQ ID NO: 33173
  hemagglutinin__InfluenzaA__AEO01206

SEQ ID NO: 37811 - RNA, 1701 nt, Artificial Sequence; identical to SEQ ID NO: 33173
  hemagglutinin__InfluenzaA__AEO01207

SEQ ID NO: 37812 - RNA, 1701 nt, Artificial Sequence
  hemagglutinin__InfluenzaA__AEO01208
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccagaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37813 - RNA, 1701 nt, Artificial Sequence
  hemagglutinin__InfluenzaA__AEO01209
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugacgguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37814 - RNA, 1701 nt, Artificial Sequence; identical to SEQ ID NO: 33173
  hemagglutinin__InfluenzaA__AEO01210

SEQ ID NO: 37815 - RNA, 1701 nt, Artificial Sequence
  hemagglutinin__InfluenzaA__AEO01211
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaggcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37816 - RNA, 1701 nt, Artificial Sequence
  hemagglutinin__InfluenzaA__AEO01212
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucguguuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccuggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37817 - RNA, 1701 nt, Artificial Sequence
  hemagglutinin__InfluenzaA__AEO01213
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauuugcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugauuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37818 - RNA, 1701 nt, Artificial Sequence
  hemagglutinin__InfluenzaA__AEO01214
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaaacauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcaugcccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuaguggcaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37819 - RNA, 1701 nt, Artificial Sequence; identical to SEQ ID NO: 35735
  hemagglutinin__InfluenzaA__AEO01215

SEQ ID NO: 37820 - RNA, 1701 nt, Artificial Sequence
  hemagglutinin__InfluenzaA__AEO01216
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccacuuggaaaaaagaguagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37821 - RNA, 1701 nt, Artificial Sequence; identical to SEQ ID NO: 35735
  hemagglutinin__InfluenzaA__AEO01217

SEQ ID NO: 37822 - RNA, 1701 nt, Artificial Sequence
  hemagglutinin__InfluenzaA__AEO01218
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccacugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37823 - RNA, 1701 nt, Artificial Sequence; identical to SEQ ID NO: 34264
  hemagglutinin__InfluenzaA__AEO01219

SEQ ID NO: 37824 - RNA, 1701 nt, Artificial Sequence; identical to SEQ ID NO: 33264
  hemagglutinin__InfluenzaA__AEO01220

SEQ ID NO: 37825 - RNA, 1701 nt, Artificial Sequence
  hemagglutinin__InfluenzaA__AEO01221
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagauuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucguguuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37826 - RNA, 1701 nt, Artificial Sequence; identical to SEQ ID NO: 33206
  hemagglutinin__InfluenzaA__AEO01222

SEQ ID NO: 37827 - RNA, 1701 nt, Artificial Sequence; identical to SEQ ID NO: 34264
  hemagglutinin__InfluenzaA__AEO01223

SEQ ID NO: 37828 - RNA, 1701 nt, Artificial Sequence
  hemagglutinin__InfluenzaA__AEO01224
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaacggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37829 - RNA, 1701 nt, Artificial Sequence
  hemagglutinin__InfluenzaA__AEO01225
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacaguaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggauuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37830 - RNA, 1701 nt, Artificial Sequence
  hemagglutinin__InfluenzaA__AEO01226
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugauggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37831 - RNA, 1701 nt, Artificial Sequence
  hemagglutinin__InfluenzaA__AEO01227
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggauagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcaugcccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37832 - RNA, 1701 nt, Artificial Sequence
  hemagglutinin__InfluenzaA__AEO01228
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccuggggaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37833 - RNA, 1701 nt, Artificial Sequence
  hemagglutinin__InfluenzaA__AEO01229
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggagaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37834 - RNA, 1701 nt, Artificial Sequence
  hemagglutinin__InfluenzaA__AEO01230
augaaggcaauacuaguaguucugcuauauacauuugcaaccgcaaaugcagacacauuauguauagguuaucaugcgaacaauucaacagacacuguagacacaguacuagaaaggaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagauuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguggauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucaaaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37835 - RNA, 1701 nt, Artificial Sequence; identical to SEQ ID NO: 33800
  hemagglutinin__InfluenzaA__AEO01231

SEQ ID NO: 37836 - RNA, 1701 nt, Artificial Sequence; identical to SEQ ID NO: 37699
  hemagglutinin__InfluenzaA__AEO01232

SEQ ID NO: 37837 - RNA, 1701 nt, Artificial Sequence
  hemagglutinin__InfluenzaA__AEO01233
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuauuauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37838 - RNA, 1701 nt, Artificial Sequence; identical to SEQ ID NO: 33173
  hemagglutinin__InfluenzaA__AEO01234

SEQ ID NO: 37839 - RNA, 1701 nt, Artificial Sequence
  hemagglutinin__InfluenzaA__AEO01235
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcaugcccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaacacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37840 - RNA, 1701 nt, Artificial Sequence
  hemagglutinin__InfluenzaA__AEO01236
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuauuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37841 - RNA, 1701 nt, Artificial Sequence
  hemagglutinin__InfluenzaA__AEO01237
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauauccaaagcucagcaaauccuacauuaaugauaaagggaaagaaguccucguguuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagcugaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37842 - RNA, 1701 nt, Artificial Sequence
  hemagglutinin__InfluenzaA__AEO01238
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugauucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaauuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37843 - RNA, 1701 nt, Artificial Sequence
  hemagglutinin__InfluenzaA__AEO01240
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaaugggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaaaggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37844 - RNA, 1701 nt, Artificial Sequence
  hemagglutinin__InfluenzaA__AEO01241
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaaaggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37845 - RNA, 1701 nt, Artificial Sequence; identical to SEQ ID NO: 33173
  hemagglutinin__InfluenzaA__AEO01242

SEQ ID NO: 37846 - RNA, 1701 nt, Artificial Sequence
  hemagglutinin__InfluenzaA__AEO01244
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaauaagacccaaagugaggggucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37847 - RNA, 1701 nt, Artificial Sequence; identical to SEQ ID NO: 33173
  hemagglutinin__InfluenzaA__AEO01245

SEQ ID NO: 37848 - RNA, 1701 nt, Artificial Sequence
  hemagglutinin__InfluenzaA__AEO01247
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauucucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37849 - RNA, 1701 nt, Artificial Sequence; identical to SEQ ID NO: 33206
  hemagglutinin__InfluenzaA__AEO01248

SEQ ID NO: 37850 - RNA, 1701 nt, Artificial Sequence; identical to SEQ ID NO: 33173
  hemagglutinin__InfluenzaA__AEO01249

SEQ ID NO: 37851 - RNA, 1701 nt, Artificial Sequence
  hemagglutinin__InfluenzaA__AEO01250
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugaagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37852 - RNA, 1701 nt, Artificial Sequence; identical to SEQ ID NO: 35358
  hemagglutinin__InfluenzaA__AEO01251

SEQ ID NO: 37853 - RNA, 1701 nt, Artificial Sequence; identical to SEQ ID NO: 33173
  hemagglutinin__InfluenzaA__AEO01252

SEQ ID NO: 37854 - RNA, 1701 nt, Artificial Sequence
  hemagglutinin__InfluenzaA__AEO01253
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuauuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37855 - RNA, 1701 nt, Artificial Sequence
  hemagglutinin__InfluenzaA__AEO01254
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaauaauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37856 - RNA, 1701 nt, Artificial Sequence
  hemagglutinin__InfluenzaA__AEO01256
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauucgaucacaauuggaaaauguccaaaauauguaaaaagcacaaaauugagacuggccacaggauugaggaauguuccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37857 - RNA, 1701 nt, Artificial Sequence; identical to SEQ ID NO: 36592
  hemagglutinin__InfluenzaA__AEO01257

SEQ ID NO: 37858 - RNA, 1701 nt, Artificial Sequence; identical to SEQ ID NO: 33173
  hemagglutinin__InfluenzaA__AEO01258

SEQ ID NO: 37859 - RNA, 1701 nt, Artificial Sequence; identical to SEQ ID NO: 37855
  hemagglutinin__InfluenzaA__AEO01259

SEQ ID NO: 37860 - RNA, 1701 nt, Artificial Sequence
  hemagglutinin__InfluenzaA__AEO01260
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggggauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaagggaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauugggaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37861 - RNA, 1701 nt, Artificial Sequence
  hemagglutinin__InfluenzaA__AEO01261
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucucuacagcaagcucaugguccuacauuguggaaacaucuaguucagacaauggaacguguuacccaggagauuucaucgauuaugaggagcuaagagagcaauugagcucagugucaucauuugaaagguuugagauauuucccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagaauggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacagggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37862 - RNA, 1701 nt, Artificial Sequence
  hemagglutinin__InfluenzaA__AEO01262
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauuaagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37863 - RNA, 1701 nt, Artificial Sequence; identical to SEQ ID NO: 36396
  hemagglutinin__InfluenzaA__AEO01263

SEQ ID NO: 37864 - RNA, 1701 nt, Artificial Sequence
  hemagglutinin__InfluenzaA__AEO01264
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaaaggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugaugagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37865 - RNA, 1701 nt, Artificial Sequence
  hemagglutinin__InfluenzaA__AEO01265
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcacaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccaugauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37866 - RNA, 1701 nt, Artificial Sequence
  hemagglutinin__InfluenzaA__AEO01266
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugaggggucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagaugcaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37867 - RNA, 1701 nt, Artificial Sequence
  hemagglutinin__InfluenzaA__AEO01267
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacaggaaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37868 - RNA, 1701 nt, Artificial Sequence
  hemagglutinin__InfluenzaA__AEO01268
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguugaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37869 - RNA, 1701 nt, Artificial Sequence
  hemagglutinin__InfluenzaA__AEO01269
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauugucauuucagauacaccaguccaugauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauggagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37870 - RNA, 1701 nt, Artificial Sequence
  hemagglutinin__InfluenzaA__AEO01270
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37871 - RNA, 1701 nt, Artificial Sequence
  hemagglutinin__InfluenzaA__AEO01271
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaaugugacauugcuggcuggauccugggaaauccagagugugaaucacucuccacagcaagcucaugguccuacauuguggaaacaccuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggaauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37872 - RNA, 1701 nt, Artificial Sequence
  hemagglutinin__InfluenzaA__AEO01272
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccaggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37873 - RNA, 1701 nt, Artificial Sequence
  hemagglutinin__InfluenzaA__AEO01273
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauuggugcugguagucucccugggggcaaucaguuucuggaugugcucuaaugggucucuacaguguagaauauguauuuaa

SEQ ID NO: 37874 - RNA, 1701 nt, Artificial Sequence
  hemagglutinin__InfluenzaA__AEO01274
augaaggcaauacuaguaguucugcuauauacauuugcaaccgcaaaugcagacacauuauguauagguuaucaugcgaacaauucaacagacacuguagacacaguauuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaguccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaguguccaaaauauguaaaaagcacaaaauugagacuggccacaggauugaggaaugucccgucuauucaaucuaggggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37875 - RNA, 1701 nt, Artificial Sequence
  hemagglutinin__InfluenzaA__AEO01275
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaguugagcucagugucaucauuugaaagguuugagauauuucccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37876 - RNA, 1701 nt, Artificial Sequence
  hemagglutinin__InfluenzaA__AEO01276
augaaggcaauacuaguaguucugcuauauacauuugcaaccgcaaaugcagacacauuauguauagguuaucaugcgaacaauucaacagacacuguagacacaguacuaaaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguugaaaaacaaugccgaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37877 - RNA, 1701 nt, Artificial Sequence
  hemagglutinin__InfluenzaA__AEO01277
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccaugauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37878 - RNA, 1701 nt, Artificial Sequence
  hemagglutinin__InfluenzaA__AEO01278
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaaugugacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggaauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagcgaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37879 - RNA, 1701 nt, Artificial Sequence
  hemagglutinin__InfluenzaA__AEO01279
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaacugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37880 - RNA, 1701 nt, Artificial Sequence
  hemagglutinin__InfluenzaA__AEO01282
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugcgaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaagggaauucauacccaaagcucagcaaauccuacauuaaugauaaagggaaagaaguccuugugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccaugauucaaaugugaagaaauuauaugaaaagguaagaagccaguuaaaaaacaaugccaaggaaauuggaaacggcugcuuugaauuuuaccacaaaugcaauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37881 - RNA, 1701 nt, Artificial Sequence
  hemagglutinin__InfluenzaA__AEO01283
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucaggcaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaacucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaccuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaauuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucgacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37882 - RNA, 1701 nt, Artificial Sequence
  hemagglutinin__InfluenzaA__AEO01284
augaaggcaauacuaguaguucugcuauauacauuugcaaucgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggaauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauaaaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37883 - RNA, 1701 nt, Artificial Sequence
  hemagglutinin__InfluenzaA__AEO01285
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagaacaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggagauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37884 - RNA, 1701 nt, Artificial Sequence; identical to SEQ ID NO: 35648
  hemagglutinin__InfluenzaA__AEO01286

SEQ ID NO: 37885 - RNA, 1701 nt, Artificial Sequence
  hemagglutinin__InfluenzaA__AEO01287
augaaggcaauacuaguaguucugcuauauacauuugcaaccgcaaauucagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugauucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaauuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37886 - RNA, 1701 nt, Artificial Sequence
  hemagglutinin__InfluenzaA__AEO01288
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagauggaguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37887 - RNA, 1701 nt, Artificial Sequence; identical to SEQ ID NO: 37780
  hemagglutinin__InfluenzaA__AEO01289

SEQ ID NO: 37888 - RNA, 1701 nt, Artificial Sequence
  hemagglutinin__InfluenzaA__AEO01290
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggagagaaaugcuggaucugguauuaucauuucagauacaccaguccacgauugcaauacaacuugucagacacccaagggugcuauaaacaccagccucucauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37889 - RNA, 1701 nt, Artificial Sequence
  hemagglutinin__InfluenzaA__AEO01291
augaaggcaauacuaguaguucugcuauauacauuugcaaccgcaaaugcagacacauuauguauagguuaucaugcgaacaauucaacagacacuguagacacaguauuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaguccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaguguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37890 - RNA, 1701 nt, Artificial Sequence; identical to SEQ ID NO: 37889
  hemagglutinin__InfluenzaA__AEO01292

SEQ ID NO: 37891 - RNA, 1701 nt, Artificial Sequence
  hemagglutinin__InfluenzaA__AEO01294
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaaugugacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggaauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37892 - RNA, 1701 nt, Artificial Sequence
  hemagglutinin__InfluenzaA__AEO01295
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaauucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacuauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaagugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37893 - RNA, 1701 nt, Artificial Sequence
  hemagglutinin__InfluenzaA__AEO01296
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguaugguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37894 - RNA, 1701 nt, Artificial Sequence; identical to SEQ ID NO: 36396
  hemagglutinin__InfluenzaA__AEO01297

SEQ ID NO: 37895 - RNA, 1701 nt, Artificial Sequence
  hemagglutinin__InfluenzaA__AEO01298
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcagucaguuucuggaugugcucuaaugggucucuacaguguagaauauguauuuaa

SEQ ID NO: 37896 - RNA, 1701 nt, Artificial Sequence; identical to SEQ ID NO: 33173
  hemagglutinin__InfluenzaA__AEO01299

SEQ ID NO: 37897 - RNA, 1701 nt, Artificial Sequence
  hemagglutinin__InfluenzaA__AEO01300
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaguccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaacgucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37898 - RNA, 1701 nt, Artificial Sequence; identical to SEQ ID NO: 33206
  hemagglutinin__InfluenzaA__AEO01301

SEQ ID NO: 37899 - RNA, 1701 nt, Artificial Sequence; identical to SEQ ID NO: 33173
  hemagglutinin__InfluenzaA__AEO01302

SEQ ID NO: 37900 - RNA, 1701 nt, Artificial Sequence
  hemagglutinin__InfluenzaA__AEO01303
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaaugggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuaccccaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37901 - RNA, 1701 nt, Artificial Sequence
  hemagglutinin__InfluenzaA__AEO01304
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaaggcaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaaggaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37902 - RNA, 1701 nt, Artificial Sequence
  hemagglutinin__InfluenzaA__AEO01305
augaaggcaauacuaguaguucugcuauauacauuugcaaccgcaagugcagacacauuauguauagguuaucaugcaaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagaaccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37903 - RNA, 1701 nt, Artificial Sequence; identical to SEQ ID NO: 33206
  hemagglutinin__InfluenzaA__AEO01306

SEQ ID NO: 37904 - RNA, 1701 nt, Artificial Sequence; identical to SEQ ID NO: 37889
  hemagglutinin__InfluenzaA__AEO01307

SEQ ID NO: 37905 - RNA, 1701 nt, Artificial Sequence; identical to SEQ ID NO: 33206
  hemagglutinin__InfluenzaA__AEO01308

SEQ ID NO: 37906 - RNA, 1701 nt, Artificial Sequence
  hemagglutinin__InfluenzaA__AEO01309
augaaggcaauacuaguaguucugcuauauacauuugcaaucgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggaauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucaaaggaagcaaaauuaaacagagaagaaauaaaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37907 - RNA, 1701 nt, Artificial Sequence
  hemagglutinin__InfluenzaA__AEO01310
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauagagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccaucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37908 - RNA, 1701 nt, Artificial Sequence; identical to SEQ ID NO: 33173
  hemagglutinin__InfluenzaA__AEO01311

SEQ ID NO: 37909 - RNA, 1701 nt, Artificial Sequence
  hemagglutinin__InfluenzaA__AEO01312
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggauaguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37910 - RNA, 1701 nt, Artificial Sequence; identical to SEQ ID NO: 35735
  hemagglutinin__InfluenzaA__AEO01313

SEQ ID NO: 37911 - RNA, 1701 nt, Artificial Sequence
  hemagglutinin__InfluenzaA__AEO01314
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccaucccucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37912 - RNA, 1701 nt, Artificial Sequence
  hemagglutinin__InfluenzaA__AEO01315
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacaggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaagcucauggcccaaucaugacucgaacaaagguguaacggcagcauguccucaugcuggagcaaaaagcuucuacaaaaauuuaauauggcugguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37913 - RNA, 1701 nt, Artificial Sequence; identical to SEQ ID NO: 33173
  hemagglutinin__InfluenzaA__AEO01316

SEQ ID NO: 37914 - RNA, 1701 nt, Artificial Sequence; identical to SEQ ID NO: 33206
  hemagglutinin__InfluenzaA__AEO01317

SEQ ID NO: 37915 - RNA, 1701 nt, Artificial Sequence; identical to SEQ ID NO: 33206
  hemagglutinin__InfluenzaA__AEO01318

SEQ ID NO: 37916 - RNA, 1701 nt, Artificial Sequence; identical to SEQ ID NO: 33173
  hemagglutinin__InfluenzaA__AEO01319

SEQ ID NO: 37917 - RNA, 1701 nt, Artificial Sequence
  hemagglutinin__InfluenzaA__AEO01321
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguuggcucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuaccccaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37918 - RNA, 1701 nt, Artificial Sequence; identical to SEQ ID NO: 35362
  hemagglutinin__InfluenzaA__AEO01322

SEQ ID NO: 37919 - RNA, 1701 nt, Artificial Sequence; identical to SEQ ID NO: 36396
  hemagglutinin__InfluenzaA__AEO01323

SEQ ID NO: 37920 - RNA, 1701 nt, Artificial Sequence; identical to SEQ ID NO: 35358
  hemagglutinin__InfluenzaA__AEO01324

SEQ ID NO: 37921 - RNA, 1701 nt, Artificial Sequence; identical to SEQ ID NO: 33173
  hemagglutinin__InfluenzaA__AEO01325

SEQ ID NO: 37922 - RNA, 1701 nt, Artificial Sequence
  hemagglutinin__InfluenzaA__AEO01326
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucaggaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37923 - RNA, 1701 nt, Artificial Sequence
  hemagglutinin__InfluenzaA__AEO01327
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguggccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37924 - RNA, 1701 nt, Artificial Sequence; identical to SEQ ID NO: 37882
  hemagglutinin__InfluenzaA__AEO01328

SEQ ID NO: 37925 - RNA, 1701 nt, Artificial Sequence; identical to SEQ ID NO: 33173
  hemagglutinin__InfluenzaA__AEO01330

SEQ ID NO: 37926 - RNA, 1701 nt, Artificial Sequence
  hemagglutinin__InfluenzaA__AEO01331
augaaggcaauacuaguaguucugcuauauacauuugcaaccgcaaaugcagacacauuauguauagguuaucaugcgaacaauucaacagacacuguagacacauuacuagaaaagaauguaacaguaacacacucuguuaaccuucuagaagacaagcauaacgggaagcuaugcaaacuaagggggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaagggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugauuacccaaaauacucagaggaagcaaaguuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37927 - RNA, 1701 nt, Artificial Sequence
  hemagglutinin__InfluenzaA__AEO01332
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuugugggguuaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauugucauuucagauacaccaguccaugauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauggagaauuuaaauaaaaaaguugaugaugguuuccuggacauuuggacuuacaaugccgaacuguugguuuuauuggaaaaugaaagaacuuuggacuaccacgauucaaaugugaagaacuuauaugaaaagguaagaagccaguuaaaaaccaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37928 - RNA, 1701 nt, Artificial Sequence; identical to SEQ ID NO: 37875
  hemagglutinin__InfluenzaA__AEO01333

SEQ ID NO: 37929 - RNA, 1701 nt, Artificial Sequence
  hemagglutinin__InfluenzaA__AEO01334
augaaggcaauacuaguaguucugcuauauacauuugcaaccgcaaaugcagacacauuauguauagguuaucaugcgaacaauucaacagacacuguagacacaauacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacagcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37930 - RNA, 1701 nt, Artificial Sequence; identical to SEQ ID NO: 37900
  hemagglutinin__InfluenzaA__AEO01335

SEQ ID NO: 37931 - RNA, 1701 nt, Artificial Sequence
  hemagglutinin__InfluenzaA__AEO01336
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucaacaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggagaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37932 - RNA, 1701 nt, Artificial Sequence
  hemagglutinin__InfluenzaA__AEO01337
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuaucacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37933 - RNA, 1701 nt, Artificial Sequence; identical to SEQ ID NO: 33206
  hemagglutinin__InfluenzaA__AEO01338

SEQ ID NO: 37934 - RNA, 1701 nt, Artificial Sequence
  hemagglutinin__InfluenzaA__AEO01339
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcacaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuacuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuauuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccaugauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37935 - RNA, 1701 nt, Artificial Sequence; identical to SEQ ID NO: 37891
  hemagglutinin__InfluenzaA__AEO01340

SEQ ID NO: 37936 - RNA, 1701 nt, Artificial Sequence; identical to SEQ ID NO: 37891
  hemagglutinin__InfluenzaA__AEO01341

SEQ ID NO: 37937 - RNA, 1701 nt, Artificial Sequence
  hemagglutinin__InfluenzaA__AEO01342
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccuugugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaauuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37938 - RNA, 1701 nt, Artificial Sequence
  hemagglutinin__InfluenzaA__AEO01343
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaauucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37939 - RNA, 1701 nt, Artificial Sequence
  hemagglutinin__InfluenzaA__AEO01344
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuaccccaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37940 - RNA, 1701 nt, Artificial Sequence
  hemagglutinin__InfluenzaA__AEO01345
augaaggcaauacuaguaguucugcuauauacauuugcaaccgcaaaugcagacacauuauguauagguuaucaugcgaacaauucaacagacacuguagacacaguauuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaguccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaguguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuauuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37941 - RNA, 1701 nt, Artificial Sequence; identical to SEQ ID NO: 33173
  hemagglutinin__InfluenzaA__AEO01346

SEQ ID NO: 37942 - RNA, 1701 nt, Artificial Sequence
  hemagglutinin__InfluenzaA__AEO01347
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggagaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37943 - RNA, 1701 nt, Artificial Sequence
  hemagglutinin__InfluenzaA__AEO01348
augaaggcaauacuaguaguucugcuauauacauuugcaaucgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaaaacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37944 - RNA, 1701 nt, Artificial Sequence
  hemagglutinin__InfluenzaA__AEO01349
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagaaaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacccagaaugccauugacgagauuacuaacaaaguaaauucuguuauugaaaagaugaauacacaguuuacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuauccaaaauacucaaaggaagcaaaacuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37945 - RNA, 1701 nt, Artificial Sequence
  hemagglutinin__InfluenzaA__AEO01350
augaaggcaauacuaguaguucugcuauauacauuugcaaccacaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucaaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggaauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaauguagaauauguauuuaa

SEQ ID NO: 37946 - RNA, 1701 nt, Artificial Sequence; identical to SEQ ID NO: 34013
  hemagglutinin__InfluenzaA__AEO01351

SEQ ID NO: 37947 - RNA, 1701 nt, Artificial Sequence; identical to SEQ ID NO: 34337
  hemagglutinin__InfluenzaA__AEO01352

SEQ ID NO: 37948 - RNA, 1701 nt, Artificial Sequence
  hemagglutinin__InfluenzaA__AEO01353
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucuuccugggggcaaucaguuucuggaugugcucuaaugggucucuacaguguagaauauguauuuaa

SEQ ID NO: 37949 - RNA, 1701 nt, Artificial Sequence
  hemagglutinin__InfluenzaA__AEO01354
augaaggcaauacuaguaguucugcuauauaaauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagccucuaucagaaugcagaugcauauguuuuuguggggacaucaagauacagcaagaaguucaagccggaaauagcaauaagacccaaagugagggaucaagaagggagaaugaauuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuagacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggagucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37950 - RNA, 1701 nt, Artificial Sequence
  hemagglutinin__InfluenzaA__AEO01355
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggaauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggauauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37951 - RNA, 1701 nt, Artificial Sequence
  hemagglutinin__InfluenzaA__AEO01356
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaguacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37952 - RNA, 1701 nt, Artificial Sequence
  hemagglutinin__InfluenzaA__AEO01358
augaaggcaauacuaguaguucugcuauauacauuugcaaccgcaaaugcagacacauuauguguagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagguacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccagcccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37953 - RNA, 1701 nt, Artificial Sequence; identical to SEQ ID NO: 35786
  hemagglutinin__InfluenzaA__AEO01359

SEQ ID NO: 37954 - RNA, 1701 nt, Artificial Sequence
  hemagglutinin__InfluenzaA__AEO01360
augaaggcaauacuaguaguucugcuauauacauuugcaaccgcaaaugcagacacauuauguauagguuaucaugcgaacaauucaacagacacuguagacacauuacuagaaaagaauguaacaguaacacacucuguuaaccuucuagaagacaagcauaacgggaagcuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugauuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37955 - RNA, 1701 nt, Artificial Sequence
  hemagglutinin__InfluenzaA__AEO01361
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccgggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccaugauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37956 - RNA, 1701 nt, Artificial Sequence
  hemagglutinin__InfluenzaA__AEO01362
augaaggcaauacuaguaguucugcuauauacauuugcaaccgcaaaugcagacacauuauguauagguuaucaugcgaacaauucaacagacacuguagacacauuacuagaaaagaauguaacaguaacacacucuguuaaccuucuagaagacaagcauaacgggaagcuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaagaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugauuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37957 - RNA, 1701 nt, Artificial Sequence; identical to SEQ ID NO: 34563
  hemagglutinin__InfluenzaA__AEO01363

SEQ ID NO: 37958 - RNA, 1701 nt, Artificial Sequence
  hemagglutinin__InfluenzaA__AEO01365
augaaggcaauacuaguaguucugcuauauacauuugcaaccgcaaaugcagacacauuauguauagguuaucaugcgaacaauucaacagacacuguagacacaguacuaaaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaagugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuaccccaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37959 - RNA, 1701 nt, Artificial Sequence
  hemagglutinin__InfluenzaA__AEO01366
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaguacaacuugucagacacccaagggugcuauaaacaccagccucccauuucagaauguacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuagacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37960 - RNA, 1701 nt, Artificial Sequence
  hemagglutinin__InfluenzaA__AEO01367
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucaacaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggagaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaacuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37961 - RNA, 1701 nt, Artificial Sequence
  hemagglutinin__InfluenzaA__AEO01368
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaaugggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaauacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaguguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguuaguuuuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37962 - RNA, 1701 nt, Artificial Sequence; identical to SEQ ID NO: 33173
  hemagglutinin__InfluenzaA__AEO01369

SEQ ID NO: 37963 - RNA, 1701 nt, Artificial Sequence; identical to SEQ ID NO: 37891
  hemagglutinin__InfluenzaA__AEO01370

SEQ ID NO: 37964 - RNA, 1701 nt, Artificial Sequence
  hemagglutinin__InfluenzaA__AEO01371
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaauucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaagugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37965 - RNA, 1701 nt, Artificial Sequence; identical to SEQ ID NO: 35358
  hemagglutinin__InfluenzaA__AEO01372

SEQ ID NO: 37966 - RNA, 1701 nt, Artificial Sequence; identical to SEQ ID NO: 35358
  hemagglutinin__InfluenzaA__AEO01373

SEQ ID NO: 37967 - RNA, 1701 nt, Artificial Sequence
  hemagglutinin__InfluenzaA__AEO01374
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaaugugacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggaauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauauaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37968 - RNA, 1701 nt, Artificial Sequence
  hemagglutinin__InfluenzaA__AEO01375
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcaggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggagaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37969 - RNA, 1701 nt, Artificial Sequence; identical to SEQ ID NO: 33173
  hemagglutinin__InfluenzaA__AEO01376

SEQ ID NO: 37970 - RNA, 1701 nt, Artificial Sequence
  hemagglutinin__InfluenzaA__AEO01377
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaguugagcucagugucaucauuugaaagguuugagauauuucccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggucuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37971 - RNA, 1701 nt, Artificial Sequence
  hemagglutinin__InfluenzaA__AEO01378
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaccuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuugugggaacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37972 - RNA, 1701 nt, Artificial Sequence
  hemagglutinin__InfluenzaA__AEO01379
augaaggcaauacuaguaguucugcuauauacauuugcaaccgcaaaugcagacacauuauguauagguuaucaugcgaacaauucaacagacacuguagacacaguacuagaaaagaaugugacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagauggggugaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37973 - RNA, 1701 nt, Artificial Sequence; identical to SEQ ID NO: 37942
  hemagglutinin__InfluenzaA__AEO01380

SEQ ID NO: 37974 - RNA, 1701 nt, Artificial Sequence; identical to SEQ ID NO: 37968
  hemagglutinin__InfluenzaA__AEO01381

SEQ ID NO: 37975 - RNA, 1701 nt, Artificial Sequence; identical to SEQ ID NO: 37972
  hemagglutinin__InfluenzaA__AEO01382

SEQ ID NO: 37976 - RNA, 1701 nt, Artificial Sequence
  hemagglutinin__InfluenzaA__AEO01383
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugagucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuaccccaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37977 - RNA, 1701 nt, Artificial Sequence
  hemagglutinin__InfluenzaA__AEO01384
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguauccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccagaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucaaacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaaaagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37978 - RNA, 1701 nt, Artificial Sequence
  hemagglutinin__InfluenzaA__AEO01385
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcaaaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuaccccaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37979 - RNA, 1701 nt, Artificial Sequence
  hemagglutinin__InfluenzaA__AEO01386
augaaggcaauacuaguaguucugcuauauacauuugcaauugcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggaauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugcagaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauaaaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37980 - RNA, 1701 nt, Artificial Sequence
  hemagglutinin__InfluenzaA__AEO01387
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuucccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucaaacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauauacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuaccccaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37981 - RNA, 1701 nt, Artificial Sequence
  hemagglutinin__InfluenzaA__AEO01388
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaaaguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaccaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37982 - RNA, 1701 nt, Artificial Sequence
  hemagglutinin__InfluenzaA__AEO01389
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggaacaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37983 - RNA, 1701 nt, Artificial Sequence
  hemagglutinin__InfluenzaA__AEO01390
augaaggcaauacuaguaguucugcuauauacauuugcaaucgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggaauucaccauccaucuacuagugcugaccaacaaagucucuaucagaaugcagaugcauauguuuuuguggagacaucaagauacagcaagaaggucaagccggaaauagcaauaagacccagagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagagguagcaaaauuaaacagagaagaaauaaaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37984 - RNA, 1701 nt, Artificial Sequence
  hemagglutinin__InfluenzaA__AEO01391
augaaggcaauacuaguaguucugcuauauacauuugcaaucgcaaaugcagacacauuauguauagguuaucaugcgaacaauucaacagacacuguagacacaguacuagaaaagaauguaacuguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggaauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauaaaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37985 - RNA, 1701 nt, Artificial Sequence; identical to SEQ ID NO: 37891
  hemagglutinin__InfluenzaA__AEO01392

SEQ ID NO: 37986 - RNA, 1701 nt, Artificial Sequence
  hemagglutinin__InfluenzaA__AEO01393
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccuagugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuaccccaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37987 - RNA, 1701 nt, Artificial Sequence; identical to SEQ ID NO: 34274
  hemagglutinin__InfluenzaA__AEO01394

SEQ ID NO: 37988 - RNA, 1701 nt, Artificial Sequence
  hemagglutinin__InfluenzaA__AEO01395
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuuccucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37989 - RNA, 1701 nt, Artificial Sequence; identical to SEQ ID NO: 34274
  hemagglutinin__InfluenzaA__AEO01396

SEQ ID NO: 37990 - RNA, 1701 nt, Artificial Sequence
  hemagglutinin__InfluenzaA__AEO01397
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaacucauacccaaagcucagcaaauccuacauuaaugauaaagggaaagaaguccucgugcuauggggcauucaccauccaucuacuagugcugaccaacaaagucucuaucagaauacagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccaugauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37991 - RNA, 1701 nt, Artificial Sequence
  hemagglutinin__InfluenzaA__AEO01398
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaguugagcucagugucaucauuugaaagguuugagauauuucccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcaaauguuuuuguggggacaucaagauacagcaagaaguucaagccggaaauagcaauaagacccaaagugaggggucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37992 - RNA, 1701 nt, Artificial Sequence; identical to SEQ ID NO: 37891
  hemagglutinin__InfluenzaA__AEO01399

SEQ ID NO: 37993 - RNA, 1701 nt, Artificial Sequence; identical to SEQ ID NO: 33173
  hemagglutinin__InfluenzaA__AEO01402

SEQ ID NO: 37994 - RNA, 1701 nt, Artificial Sequence; identical to SEQ ID NO: 34337
  hemagglutinin__InfluenzaA__AEO01403

SEQ ID NO: 37995 - RNA, 1701 nt, Artificial Sequence
  hemagglutinin__InfluenzaA__AEO01404
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggaucuugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacguguauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37996 - RNA, 1701 nt, Artificial Sequence
  hemagglutinin__InfluenzaA__AEO01405
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaauuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaugauuuaccagauuuuggcgaucuauucaacugucgccaguucauugguacugguagucucccugggggcaaucaguuucuggaugugcucuaaugggucucuacaguguagaauauguauuuaa

SEQ ID NO: 37997 - RNA, 1701 nt, Artificial Sequence
  hemagglutinin__InfluenzaA__AEO01407
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggaauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaaaggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaggcaaaauuaaacagagaagaaauaaaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37998 - RNA, 1701 nt, Artificial Sequence
  hemagglutinin__InfluenzaA__AEO01408
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacagcagcauguccucaugcuggagcaaaaagcuucuacaaaaauuuaauauggcuaguuaaaaaaggaaauucauacccaaagcucagcaaauccuacauuaaugauaaaggaaaagaaguucucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaauugaugaugguuuccuggacauuuggacuuacaaugccgagcuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 37999 - RNA, 1701 nt, Artificial Sequence; identical to SEQ ID NO: 34679
  hemagglutinin__InfluenzaA__AEO01409

SEQ ID NO: 38000 - RNA, 1701 nt, Artificial Sequence; identical to SEQ ID NO: 37891
  hemagglutinin__InfluenzaA__AEO01410

SEQ ID NO: 38001 - RNA, 1701 nt, Artificial Sequence; identical to SEQ ID NO: 36592
  hemagglutinin__InfluenzaA__AEO01411

SEQ ID NO: 38002 - RNA, 1701 nt, Artificial Sequence; identical to SEQ ID NO: 34264
  hemagglutinin__InfluenzaA__AEO01412

SEQ ID NO: 38003 - RNA, 1701 nt, Artificial Sequence
  hemagglutinin__InfluenzaA__AEO01413
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaagcaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38004 - RNA, 1701 nt, Artificial Sequence
  hemagglutinin__InfluenzaA__AEO01414
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaauacuggaucugguauuaucauuucagauacaccaguccacgauugcaguacaacuugucagacacccaagggugcuauaaacaccagccucccauuucagaauguacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuagacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38005 - RNA, 1701 nt, Artificial Sequence
  hemagglutinin__InfluenzaA__AEO01416
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguagaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacuggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38006 - RNA, 1701 nt, Artificial Sequence; identical to SEQ ID NO: 34337
  hemagglutinin__InfluenzaA__AEO01418

SEQ ID NO: 38007 - RNA, 1701 nt, Artificial Sequence; identical to SEQ ID NO: 34337
  hemagglutinin__InfluenzaA__AEO01419

SEQ ID NO: 38008 - RNA, 1701 nt, Artificial Sequence
  hemagglutinin__InfluenzaA__AEO01420
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaauacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaauucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaaguuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuagaaaaaagaauagagaauuuaaauaaaaaaguugaugaugguuuccuggacauuuggacuuacaaugccgaauuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38009 - RNA, 1701 nt, Artificial Sequence
  hemagglutinin__InfluenzaA__AEO01421
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaaaguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaauuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38010 - RNA, 1701 nt, Artificial Sequence
  hemagglutinin__InfluenzaA__AEO01422
augaaggcaauacuaguaguucugcuauauacauuugcaaucgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauuuauacccaaagcucagcaaauccuacauuaaugauaaagggaaagaaguccucgugcuauggggaauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauaaaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38011 - RNA, 1701 nt, Artificial Sequence
  hemagglutinin__InfluenzaA__AEO01423
augaaggcaauacuaauaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauaacuauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguaauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38012 - RNA, 1701 nt, Artificial Sequence; identical to SEQ ID NO: 38009
  hemagglutinin__InfluenzaA__AEO01424

SEQ ID NO: 38013 - RNA, 1701 nt, Artificial Sequence
  hemagglutinin__InfluenzaA__AEO01425
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaaaguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38014 - RNA, 1701 nt, Artificial Sequence; identical to SEQ ID NO: 33206
  hemagglutinin__InfluenzaA__AEO01426

SEQ ID NO: 38015 - RNA, 1701 nt, Artificial Sequence
  hemagglutinin__InfluenzaA__AEO01427
augaaggcaauacuaguaguucugcuauauacauuugcaaccgcaaauucagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauauucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38016 - RNA, 1701 nt, Artificial Sequence
  hemagglutinin__InfluenzaA__AEO01428
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuucccaagacaaguucauggcccgaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagaauggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38017 - RNA, 1701 nt, Artificial Sequence; identical to SEQ ID NO: 34337
  hemagglutinin__InfluenzaA__AEO01429

SEQ ID NO: 38018 - RNA, 1701 nt, Artificial Sequence
  hemagglutinin__InfluenzaA__AEO01430
augaaggcaauacuaguaguucugcuauauacauuugcaaccgcaaaugcagacacauuauguaucgguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugauggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaauuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38019 - RNA, 1701 nt, Artificial Sequence; identical to SEQ ID NO: 37891
  hemagglutinin__InfluenzaA__AEO01431

SEQ ID NO: 38020 - RNA, 1701 nt, Artificial Sequence; identical to SEQ ID NO: 33800
  hemagglutinin__InfluenzaA__AEO01432

SEQ ID NO: 38021 - RNA, 1701 nt, Artificial Sequence
  hemagglutinin__InfluenzaA__AEO01434
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuugggugaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucaacaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggagaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38022 - RNA, 1701 nt, Artificial Sequence
  hemagglutinin__InfluenzaA__AEO01435
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccagucuacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38023 - RNA, 1701 nt, Artificial Sequence; identical to SEQ ID NO: 38013
  hemagglutinin__InfluenzaA__AEO01436

SEQ ID NO: 38024 - RNA, 1701 nt, Artificial Sequence; identical to SEQ ID NO: 37891
  hemagglutinin__InfluenzaA__AEO01437

SEQ ID NO: 38025 - RNA, 1701 nt, Artificial Sequence
  hemagglutinin__InfluenzaA__AEO01438
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccagaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaacauacauccgaucacaauuggagaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38026 - RNA, 1701 nt, Artificial Sequence
  hemagglutinin__InfluenzaA__AEO01440
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaaaggugcuauaaacaccagccucccauuucagaauauacauccgaucacaauugggaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguaggauauguauuuaa

SEQ ID NO: 38027 - RNA, 1701 nt, Artificial Sequence
  hemagglutinin__InfluenzaA__AEO01441
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugauggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38028 - RNA, 1701 nt, Artificial Sequence
  hemagglutinin__InfluenzaA__AEO01442
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggaauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaagugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38029 - RNA, 1701 nt, Artificial Sequence
  hemagglutinin__InfluenzaA__AEO01443
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaagaaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38030 - RNA, 1701 nt, Artificial Sequence
  hemagglutinin__InfluenzaA__AEO01444
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaauucagacaauggaacguguuacccaggagauuucaucgauuaugaggagcuaagagagcaauugagcucagugucaucauuugaaagguuugagauauuccccaagacaaguucauggcccaaucaugacucggacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauuaaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38031 - RNA, 1701 nt, Artificial Sequence
  hemagglutinin__InfluenzaA__AEO01445
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38032 - RNA, 1701 nt, Artificial Sequence; identical to SEQ ID NO: 37891
  hemagglutinin__InfluenzaA__AEO01446

SEQ ID NO: 38033 - RNA, 1701 nt, Artificial Sequence
  hemagglutinin__InfluenzaA__AEO01447
augaaggcaauacuaguaguucugcuauauacauuugcuaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaaugcaacauugcuggcuggauccugggaaauccagagugugaaucacucuccacagcaagcucaugguccuacauuguagaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaauuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacuaucgccaguucauugguacugguagucucccugggggcaaucaguuucuggaugugcucuaaugggucucuacaguguagaauauguauuuaa

SEQ ID NO: 38034 - RNA, 1701 nt, Artificial Sequence
  hemagglutinin__InfluenzaA__AEO01448
augaaggcaauacuaguaguucugcuauauacauuugcaaccgcaaaugcagacacauuauguauagguuaucaugcgaacaauucaacagacacuguagacacagugcuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuacuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38035 - RNA, 1701 nt, Artificial Sequence; identical to SEQ ID NO: 38013
  hemagglutinin__InfluenzaA__AEO01449

SEQ ID NO: 38036 - RNA, 1701 nt, Artificial Sequence
  hemagglutinin__InfluenzaA__AEO01450
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaaugcaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggaauucaccauccaucuacuaguacugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaauguagaauauguauuuaa

SEQ ID NO: 38037 - RNA, 1701 nt, Artificial Sequence; identical to SEQ ID NO: 35362
  hemagglutinin__InfluenzaA__AEO01451

SEQ ID NO: 38038 - RNA, 1701 nt, Artificial Sequence
  hemagglutinin__InfluenzaA__AEO01452
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcaugcccucaugcugaagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuugugggaacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccagcccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaaauuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagauggaguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38039 - RNA, 1701 nt, Artificial Sequence
  hemagglutinin__InfluenzaA__AEO01453
augaaggcaauacuaguaguucugcuauauacauuugcaaucgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacauccaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggaguucaccauccaucuacuagugcugaccaacaaagucucuaucagaaugcagaugcauauguuuuuguggggacaucaagauacagcaagaaguucaagcgggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauaaaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38040 - RNA, 1701 nt, Artificial Sequence
  hemagglutinin__InfluenzaA__AEO01454
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucauggucauacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaccacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuaccccaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38041 - RNA, 1701 nt, Artificial Sequence
  hemagglutinin__InfluenzaA__AEO01455
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcgggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcagggaucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38042 - RNA, 1701 nt, Artificial Sequence
  hemagglutinin__InfluenzaA__AEO01456
augaaggcaauacuaauaguucugcuauauacauuugcaaccgcaaaugcagacacauuauguauagguuaucaugcgaacaauucaacagacacuguagacacauuacuagaaaagaauguaacaguaacacacucuguuaaccuucuagaagacaagcauaacgggaagcuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuucccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauuugaagcaacuggaaaucuagugguaccgagauaugcauucgcaauggacagaaaugcuggaucugguauuaucauuucagaugcaccaguccacgauugcaauacaacuugucagacacccaagggugcuauaaacaccagccucccauuucagaauauacauccgaucacaauuggaaaauguccaaaauauguaaaaagcacaaaauugagacuggccacgggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaauucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugauuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38043 - RNA, 1701 nt, Artificial Sequence; identical to SEQ ID NO: 37942
  hemagglutinin__InfluenzaA__AEO01457

SEQ ID NO: 38044 - RNA, 1701 nt, Artificial Sequence
  hemagglutinin__InfluenzaA__AEO01458
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaauucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaacauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaagugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38045 - RNA, 1701 nt, Artificial Sequence
  hemagglutinin__InfluenzaA__AEO01459
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaauucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 38046 - RNA, 1701 nt, Artificial Sequence
  hemagglutinin__InfluenzaA__AEO01461
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggaauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacacuagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauaugcauuuaa

SEQ ID NO: 38047 - RNA, 1701 nt, Artificial Sequence; identical to SEQ ID NO: 37883
  hemagglutinin__InfluenzaA__AEO01462

SEQ ID NO: 38048 - RNA, 1701 nt, Artificial Sequence
  hemagglutinin__InfluenzaA__AEO01463
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccgggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccaugauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaaaaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38049 - RNA, 1701 nt, Artificial Sequence
  hemagglutinin__InfluenzaA__AEO01464
augaaggcaauacuaguaguucugcuauauacauuugcaaccgcaaaugcagacacauuauguauagguuaucaugcgaacaauucaacagacacuguagacacauuacuagaaaagaauguaacaguaacacacucuguuaaccuucuagaagacaagcauaacgggaagcuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaggugagggaucaagaagggagaaugaacuauuacuggacauuaguagagccgggagacaaaauaacauucgaagcaacuggaaaucuagugguaccgagauaugcauucgcaauggacagaaaugcuggaucugguauuaucauuucagauacaucaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaauucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugauuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38050 - RNA, 1701 nt, Artificial Sequence; identical to SEQ ID NO: 38029
  hemagglutinin__InfluenzaA__AEO01465

SEQ ID NO: 38051 - RNA, 1701 nt, Artificial Sequence; identical to SEQ ID NO: 35062
  hemagglutinin__InfluenzaA__AEO01466

SEQ ID NO: 38052 - RNA, 1701 nt, Artificial Sequence; identical to SEQ ID NO: 37955
  hemagglutinin__InfluenzaA__AEO01467

SEQ ID NO: 38053 - RNA, 1701 nt, Artificial Sequence
  hemagglutinin__InfluenzaA__AEO01468
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacgucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38054 - RNA, 1701 nt, Artificial Sequence
  hemagglutinin__InfluenzaA__AEO01469
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaauuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaagaauuuaccagauuuuggcgaucuauucaacugucgccaguucauugguacugguagucucccugggggcaaucaguuucuggaugugcucuaauggaucucuacaguguagaauauguauuuaa

SEQ ID NO: 38055 - RNA, 1701 nt, Artificial Sequence
  hemagglutinin__InfluenzaA__AEO01470
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugauaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaauuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaagaauuuaccagauuuuggcgaucuauucaacugucgccaguucauugguacugguagucucccugggggcaaucaguuucuggaugugcucuaaugggucucuacaguguagaauauguauuuaa

SEQ ID NO: 38056 - RNA, 1701 nt, Artificial Sequence; identical to SEQ ID NO: 37882
  hemagglutinin__InfluenzaA__AEO01471

SEQ ID NO: 38057 - RNA, 1701 nt, Artificial Sequence
  hemagglutinin__InfluenzaA__AEO01472
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaagcuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauuuggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauuagacccaaagugagggaucaagaagggagaaugaacuauuacuggacacuaguagagccgggagacaaaauaacauucgaagcaacuggaaaucuagugguaccaagauaugcauucgcaauggaaagaaaugcuggaucugguauuaucauuucagauacaccaguccaugauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaguuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuucuggaugugcucuaaugggucucuacaguguagaauauguauuuaa

SEQ ID NO: 38058 - RNA, 1701 nt, Artificial Sequence
  hemagglutinin__InfluenzaA__AEO01473
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucaacaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccgagggugcuauaaacaccagccucccauuucagaauauacauccgaucacaauuggagaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38059 - RNA, 1701 nt, Artificial Sequence
  hemagglutinin__InfluenzaA__AEO01474
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucggacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38060 - RNA, 1701 nt, Artificial Sequence
  hemagglutinin__InfluenzaA__AEO01475
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaauucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucaguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38061 - RNA, 1701 nt, Artificial Sequence
  hemagglutinin__InfluenzaA__AEO01476
augaaggcaauacuaguaguucugcuauauacauuuucaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgacuugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38062 - RNA, 1701 nt, Artificial Sequence
  hemagglutinin__InfluenzaA__AEO01477
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauaugcuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccacuuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38063 - RNA, 1701 nt, Artificial Sequence
  hemagglutinin__InfluenzaA__AEO01478
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaauggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggauuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38064 - RNA, 1701 nt, Artificial Sequence
  hemagglutinin__InfluenzaA__AEO01479
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaaugugacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggaauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagggaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38065 - RNA, 1701 nt, Artificial Sequence; identical to SEQ ID NO: 37964
  hemagglutinin__InfluenzaA__AEO01480

SEQ ID NO: 38066 - RNA, 1701 nt, Artificial Sequence
  hemagglutinin__InfluenzaA__AEO01482
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcaauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38067 - RNA, 1701 nt, Artificial Sequence
  hemagglutinin__InfluenzaA__AEO01483
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaauucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaagggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuucuggaugugcucuaaugggucucuacaguguagaauauguauuuaa

SEQ ID NO: 38068 - RNA, 1701 nt, Artificial Sequence
  hemagglutinin__InfluenzaA__AEO01484
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaaaagggguagccccauugcauuuggguaaaugugacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggaauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38069 - RNA, 1701 nt, Artificial Sequence
  hemagglutinin__InfluenzaA__AEO01485
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauaacaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaauuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38070 - RNA, 1701 nt, Artificial Sequence
  hemagglutinin__InfluenzaA__AEO01487
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccaggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcuguuuugaauuuuaccacaaaugcgauaacacgugcauggaaagugucaaaaaugggacuuaugacuacccaaaauacucagaggaagcaaaauuaaacagagaagaaauagaugggguaacgcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38071 - RNA, 1701 nt, Artificial Sequence
  hemagglutinin__InfluenzaA__AEO01488
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucaaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgggauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38072 - RNA, 1701 nt, Artificial Sequence
  hemagglutinin__InfluenzaA__AEO01489
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguggccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaggccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaauuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38073 - RNA, 1701 nt, Artificial Sequence
  hemagglutinin__InfluenzaA__AEO01490
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuucccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagaauggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38074 - RNA, 1701 nt, Artificial Sequence
  hemagglutinin__InfluenzaA__AEO01491
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaaguauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuaucacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccuaaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38075 - RNA, 1701 nt, Artificial Sequence
  hemagglutinin__InfluenzaA__AEO01492
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucguguuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggagaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38076 - RNA, 1701 nt, Artificial Sequence
  hemagglutinin__InfluenzaA__AEO01493
augaaggcaauacuaguaguucugcuauauacauucgcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccacugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaagugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuaccccaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38077 - RNA, 1701 nt, Artificial Sequence
  hemagglutinin__InfluenzaA__AEO01494
augaaggcaauacuaguaguucugcuauauacauuugcaaccgcaaaugcagacacacuaugcacagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaguugagcucagugucaucauuugaaagguuugagauauuucccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38078 - RNA, 1701 nt, Artificial Sequence; identical to SEQ ID NO: 34770
  hemagglutinin__InfluenzaA__AEO01496

SEQ ID NO: 38079 - RNA, 1701 nt, Artificial Sequence
  hemagglutinin__InfluenzaA__AEO01497
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccgggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccaugauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaauacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38080 - RNA, 1701 nt, Artificial Sequence; identical to SEQ ID NO: 35358
  hemagglutinin__InfluenzaA__AEO01498

SEQ ID NO: 38081 - RNA, 1701 nt, Artificial Sequence
  hemagglutinin__InfluenzaA__AEO01499
augaaggcaauacuaguaguucugcuauauacauuugcaaucgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggaauucaccauccauauacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauaaaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38082 - RNA, 1701 nt, Artificial Sequence; identical to SEQ ID NO: 37883
  hemagglutinin__InfluenzaA__AEO01500

SEQ ID NO: 38083 - RNA, 1701 nt, Artificial Sequence; identical to SEQ ID NO: 34337
  hemagglutinin__InfluenzaA__AEO01501

SEQ ID NO: 38084 - RNA, 1701 nt, Artificial Sequence
  hemagglutinin__InfluenzaA__AEO01502
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaauuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38085 - RNA, 1701 nt, Artificial Sequence
  hemagglutinin__InfluenzaA__AEO01503
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagaguacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38086 - RNA, 1701 nt, Artificial Sequence; identical to SEQ ID NO: 35358
  hemagglutinin__InfluenzaA__AEO01505

SEQ ID NO: 38087 - RNA, 1701 nt, Artificial Sequence; identical to SEQ ID NO: 37883
  hemagglutinin__InfluenzaA__AEO01506

SEQ ID NO: 38088 - RNA, 1701 nt, Artificial Sequence; identical to SEQ ID NO: 37882
  hemagglutinin__InfluenzaA__AEO01507

SEQ ID NO: 38089 - RNA, 1701 nt, Artificial Sequence; identical to SEQ ID NO: 35358
  hemagglutinin__InfluenzaA__AEO01508

SEQ ID NO: 38090 - RNA, 1701 nt, Artificial Sequence; identical to SEQ ID NO: 34501
  hemagglutinin__InfluenzaA__AEO01510

SEQ ID NO: 38091 - RNA, 1701 nt, Artificial Sequence
  hemagglutinin__InfluenzaA__AEO01511
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguaaccccauugcauuuggguaaauguaacauugcuggcuggauccugggaaauccagagugugaaucacucuccacaacaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacuggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38092 - RNA, 1701 nt, Artificial Sequence
  hemagglutinin__InfluenzaA__AEO01512
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccgggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccaugauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacaagugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38093 - RNA, 1701 nt, Artificial Sequence
  hemagglutinin__InfluenzaA__AEO01513
augaaggcaauacuagcaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccggucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38094 - RNA, 1701 nt, Artificial Sequence
  hemagglutinin__InfluenzaA__AEO01514
augaaggcaauacuaguaguucugcuauauacauuugcaaccgcaaaugcagacacauuauguauagguuaucaugcaaacaauucaacagacacuguagacacaguacuagaaaagaauguaacaguaacacacucuguuaaccuucuagaagacaugcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaaaccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacuggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucugaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38095 - RNA, 1701 nt, Artificial Sequence
  hemagglutinin__InfluenzaA__AEO01515
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacguucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuaccccaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38096 - RNA, 1701 nt, Artificial Sequence; identical to SEQ ID NO: 37942
  hemagglutinin__InfluenzaA__AEO01516

SEQ ID NO: 38097 - RNA, 1701 nt, Artificial Sequence
  hemagglutinin__InfluenzaA__AEO01517
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaagaaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaggcaaaauuaaacagagaagaaauagaugggguaaagcuggaaucaacaaggauuuaccagauuuuggcgaucuacucaacugucgccaguucauugguacugguagucucccugggggcaaucaguuucuggaugugcucuaaugggucucuacaguguagaauauguauuuaa

SEQ ID NO: 38098 - RNA, 1701 nt, Artificial Sequence
  hemagglutinin__InfluenzaA__AEO01518
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggauaguuaaaaaaggaaauucauacccaaagcucaacaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacacccgaucacaauuggagaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38099 - RNA, 1701 nt, Artificial Sequence
  hemagglutinin__InfluenzaA__AEO01519
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaggccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38100 - RNA, 1701 nt, Artificial Sequence
  hemagglutinin__InfluenzaA__AEO01520
augaaggcaauacuaguaguucugcuauauacauuugaaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaauggugcuauaaacaccagccucccauuucagaauauacauccgaucacaauuggaaaauguccaaaauauguaaaaagcacaaaauugagacuggccacaggauugaggaaugucccgucuauucagucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38101 - RNA, 1701 nt, Artificial Sequence
  hemagglutinin__InfluenzaA__AEO01521
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauuuggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauuagacccaaagugagggaucaagaagggagaaugaacuauuacuggacacuaguagagccgggagacaaaauaacauucgaagcaacuggaaaucuagugguaccaagauaugcauucgcaauggaaagaaaugcuggaucugguauuaucauuucagauacaccaguccaugauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaguuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuucuggaugugcucuaaugggucucuacaguguagaauauguauuuaa

SEQ ID NO: 38102 - RNA, 1701 nt, Artificial Sequence
  hemagglutinin__InfluenzaA__AEO01522
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacagagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaauaccagccucccauuucagaauguacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38103 - RNA, 1701 nt, Artificial Sequence; identical to SEQ ID NO: 34337
  hemagglutinin__InfluenzaA__AEO01523

SEQ ID NO: 38104 - RNA, 1701 nt, Artificial Sequence; identical to SEQ ID NO: 37931
  hemagglutinin__InfluenzaA__AEO01524

SEQ ID NO: 38105 - RNA, 1701 nt, Artificial Sequence
  hemagglutinin__InfluenzaA__AEO01525
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucaggcaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaacucauacccaaggcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggaggaugaacuauuacuggacacuaguagagccgggagacaaaauaacauucgaagcaacuggaaaccuagugguaccgagauaugcauucgcaauggaaagaaaugcuggaucugguauuaucauuucagauacaccaguccacgacugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaaaagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaauuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucgacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38106 - RNA, 1701 nt, Artificial Sequence
  hemagglutinin__InfluenzaA__AEO01526
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuugauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacgaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38107 - RNA, 1701 nt, Artificial Sequence
  hemagglutinin__InfluenzaA__AEO01527
augaaggcaauacuaauaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagaacaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggagccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38108 - RNA, 1701 nt, Artificial Sequence
  hemagglutinin__InfluenzaA__AEO01529
augaaggcaauacuaguaguucugcuauauacauuugcaaccgcaaaugcagacacauuauguauagguuaccaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauuuggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauuagacccaaagugagggaucaagaagggagaaugaacuauuacuggacacuaguagagccgggagacaaaauaacauucgaagcaacuggaaaucuagugguaccaagauaugcauucgcaauggaaagaaaugcuggaucugguauuaucauuucagauacaccaguccaugauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaguuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugccgccaguucauugguacugguagucucccugggggcaaucaguuucuggaugugcucuaaugggucucuacaguguagaauauguauuuaa

SEQ ID NO: 38109 - RNA, 1701 nt, Artificial Sequence
  hemagglutinin__InfluenzaA__AEO01530
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggagauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaauuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38110 - RNA, 1701 nt, Artificial Sequence
  hemagglutinin__InfluenzaA__AEO01531
augaaggcaauacuaguaguucugcuauauacauuugcaaccgcaaauacagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacuggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggguuuaccagauuuuggcgaucuauucaacugucgccaguucauugguacugguagucucccugggggcaaucaguuucuggaugugcucuaaugggucucuacaguguagaauauguauuuaa

SEQ ID NO: 38111 - RNA, 1701 nt, Artificial Sequence; identical to SEQ ID NO: 37942
  hemagglutinin__InfluenzaA__AEO01532

SEQ ID NO: 38112 - RNA, 1701 nt, Artificial Sequence
  hemagglutinin__InfluenzaA__AEO01533
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguugaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacguguauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38113 - RNA, 1701 nt, Artificial Sequence
  hemagglutinin__InfluenzaA__AEO01534
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagaucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggaauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguccugguagucucccugggggcaaucaguuucuggaugugcucuaaugggucucuacaauguagaauauguauuuaa

SEQ ID NO: 38114 - RNA, 1701 nt, Artificial Sequence
  hemagglutinin__InfluenzaA__AEO01535
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacucuugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccaaauuuuggcgaucuauucaacugucgccaguucauugguacugguagucucccugggggcaaucaguuucuggaugugcucuaaugggucucuacaguguagaauauguauuuaa

SEQ ID NO: 38115 - RNA, 1701 nt, Artificial Sequence
  hemagglutinin__InfluenzaA__AEO01536
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaaugcaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38116 - RNA, 1701 nt, Artificial Sequence; identical to SEQ ID NO: 38100
  hemagglutinin__InfluenzaA__AEO01537

SEQ ID NO: 38117 - RNA, 1701 nt, Artificial Sequence
  hemagglutinin__InfluenzaA__AEO01538
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaggagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaggguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguucacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuucuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38118 - RNA, 1701 nt, Artificial Sequence; identical to SEQ ID NO: 38101
  hemagglutinin__InfluenzaA__AEO01539

SEQ ID NO: 38119 - RNA, 1701 nt, Artificial Sequence
  hemagglutinin__InfluenzaA__AEO01540
augaaggcaauacuaguaguucugcuauauacauuugcaauugcaaaugcagacacauuauguauagguuaucaugcgaacaauucaacagacacuguagacacaguacuagaaaagaauguaacaguaacacacucuguuaaccuucuagaagacaagcauaacgagaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggaauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuagccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauaaaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38120 - RNA, 1701 nt, Artificial Sequence
  hemagglutinin__InfluenzaA__AEO01541
augaaggcaauacuaguaguucugcuauauacauuugcaaccgcaaaugcagacacauuauguauagguuaccaugcgaacaauucaacagacacuguagacacaguacuagaaaagaauguaacaguaacacacucuguuaaccuucuagaagacaagcauaacgggaaacuaugcaaacuaagaggaguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38121 - RNA, 1701 nt, Artificial Sequence
  hemagglutinin__InfluenzaA__AEO01542
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacgguugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38122 - RNA, 1701 nt, Artificial Sequence
  hemagglutinin__InfluenzaA__AEO01543
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccuggggaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagauuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucuuuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38123 - RNA, 1701 nt, Artificial Sequence; identical to SEQ ID NO: 37883
  hemagglutinin__InfluenzaA__AEO01544

SEQ ID NO: 38124 - RNA, 1701 nt, Artificial Sequence
  hemagglutinin__InfluenzaA__AEO01545
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauagcgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucgucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38125 - RNA, 1701 nt, Artificial Sequence; identical to SEQ ID NO: 33168
  hemagglutinin__InfluenzaA__AEO01546

SEQ ID NO: 38126 - RNA, 1701 nt, Artificial Sequence
  hemagglutinin__InfluenzaA__AEO01547
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacagcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38127 - RNA, 1701 nt, Artificial Sequence; identical to SEQ ID NO: 33390
  hemagglutinin__InfluenzaA__AEO01548

SEQ ID NO: 38128 - RNA, 1701 nt, Artificial Sequence; identical to SEQ ID NO: 33264
  hemagglutinin__InfluenzaA__AEO01549

SEQ ID NO: 38129 - RNA, 1701 nt, Artificial Sequence; identical to SEQ ID NO: 33173
  hemagglutinin__InfluenzaA__AEO01550

SEQ ID NO: 38130 - RNA, 1701 nt, Artificial Sequence; identical to SEQ ID NO: 33173
  hemagglutinin__InfluenzaA__AEO01551

SEQ ID NO: 38131 - RNA, 1701 nt, Artificial Sequence; identical to SEQ ID NO: 33173
  hemagglutinin__InfluenzaA__AEO01552

SEQ ID NO: 38132 - RNA, 1701 nt, Artificial Sequence; identical to SEQ ID NO: 33173
  hemagglutinin__InfluenzaA__AEO01553

SEQ ID NO: 38133 - RNA, 1701 nt, Artificial Sequence; identical to SEQ ID NO: 33173
  hemagglutinin__InfluenzaA__AEO01554

SEQ ID NO: 38134 - RNA, 1701 nt, Artificial Sequence; identical to SEQ ID NO: 33390
  hemagglutinin__InfluenzaA__AEO01555

SEQ ID NO: 38135 - RNA, 1701 nt, Artificial Sequence; identical to SEQ ID NO: 33173
  hemagglutinin__InfluenzaA__AEO01557

SEQ ID NO: 38136 - RNA, 1701 nt, Artificial Sequence; identical to SEQ ID NO: 33173
  hemagglutinin__InfluenzaA__AEO01558

SEQ ID NO: 38137 - RNA, 1701 nt, Artificial Sequence
  hemagglutinin__InfluenzaA__AEO01559
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccaagauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38138 - RNA, 1701 nt, Artificial Sequence; identical to SEQ ID NO: 33173
  hemagglutinin__InfluenzaA__AEO01560

SEQ ID NO: 38139 - RNA, 1701 nt, Artificial Sequence; identical to SEQ ID NO: 33173
  hemagglutinin__InfluenzaA__AEO01561

SEQ ID NO: 38140 - RNA, 1701 nt, Artificial Sequence; identical to SEQ ID NO: 33173
  hemagglutinin__InfluenzaA__AEO01562

SEQ ID NO: 38141 - RNA, 1701 nt, Artificial Sequence; identical to SEQ ID NO: 33173
  hemagglutinin__InfluenzaA__AEO01563

SEQ ID NO: 38142 - RNA, 1701 nt, Artificial Sequence; identical to SEQ ID NO: 33173
  hemagglutinin__InfluenzaA__AEO01564

SEQ ID NO: 38143 - RNA, 1701 nt, Artificial Sequence; identical to SEQ ID NO: 33173
  hemagglutinin__InfluenzaA__AEO01565

SEQ ID NO: 38144 - RNA, 1701 nt, Artificial Sequence
  hemagglutinin__InfluenzaA__AEO01566
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcagggaucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38145 - RNA, 1701 nt, Artificial Sequence; identical to SEQ ID NO: 33457
  hemagglutinin__InfluenzaA__AEO01567

SEQ ID NO: 38146 - RNA, 1701 nt, Artificial Sequence; identical to SEQ ID NO: 33355
  hemagglutinin__InfluenzaA__AEO01568

SEQ ID NO: 38147 - RNA, 1701 nt, Artificial Sequence; identical to SEQ ID NO: 33355
  hemagglutinin__InfluenzaA__AEO01569

SEQ ID NO: 38148 - RNA, 1701 nt, Artificial Sequence; identical to SEQ ID NO: 33457
  hemagglutinin__InfluenzaA__AEO01570

SEQ ID NO: 38149 - RNA, 1701 nt, Artificial Sequence; identical to SEQ ID NO: 33355
  hemagglutinin__InfluenzaA__AEO01571

SEQ ID NO: 38150 - RNA, 1701 nt, Artificial Sequence; identical to SEQ ID NO: 33457
  hemagglutinin__InfluenzaA__AEO01572

SEQ ID NO: 38151 - RNA, 1701 nt, Artificial Sequence; identical to SEQ ID NO: 33168
  hemagglutinin__InfluenzaA__AEO01573

SEQ ID NO: 38152 - RNA, 1701 nt, Artificial Sequence
  hemagglutinin__InfluenzaA__AEO01574
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggauuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38153 - RNA, 1701 nt, Artificial Sequence; identical to SEQ ID NO: 33168
  hemagglutinin__InfluenzaA__AEO01575

SEQ ID NO: 38154 - RNA, 1701 nt, Artificial Sequence; identical to SEQ ID NO: 33168
  hemagglutinin__InfluenzaA__AEO01576

SEQ ID NO: 38155 - RNA, 1701 nt, Artificial Sequence; identical to SEQ ID NO: 33168
  hemagglutinin__InfluenzaA__AEO01577

SEQ ID NO: 38156 - RNA, 1701 nt, Artificial Sequence; identical to SEQ ID NO: 33457
  hemagglutinin__InfluenzaA__AEO01578

SEQ ID NO: 38157 - RNA, 1701 nt, Artificial Sequence; identical to SEQ ID NO: 33457
  hemagglutinin__InfluenzaA__AEO01579

SEQ ID NO: 38158 - RNA, 1701 nt, Artificial Sequence; identical to SEQ ID NO: 33168
  hemagglutinin__InfluenzaA__AEO01581

SEQ ID NO: 38159 - RNA, 1701 nt, Artificial Sequence; identical to SEQ ID NO: 33168
  hemagglutinin__InfluenzaA__AEO01582

SEQ ID NO: 38160 - RNA, 1701 nt, Artificial Sequence; identical to SEQ ID NO: 33168
  hemagglutinin__InfluenzaA__AEO01583

SEQ ID NO: 38161 - RNA, 1701 nt, Artificial Sequence; identical to SEQ ID NO: 33168
  hemagglutinin__InfluenzaA__AEO01584

SEQ ID NO: 38162 - RNA, 1701 nt, Artificial Sequence; identical to SEQ ID NO: 33168
  hemagglutinin__InfluenzaA__AEO01585

SEQ ID NO: 38163 - RNA, 1701 nt, Artificial Sequence; identical to SEQ ID NO: 33168
  hemagglutinin__InfluenzaA__AEO01586

SEQ ID NO: 38164 - RNA, 1701 nt, Artificial Sequence; identical to SEQ ID NO: 33168
  hemagglutinin__InfluenzaA__AEO01587

SEQ ID NO: 38165 - RNA, 1701 nt, Artificial Sequence; identical to SEQ ID NO: 33168
  hemagglutinin__InfluenzaA__AEO01588

SEQ ID NO: 38166 - RNA, 1701 nt, Artificial Sequence; identical to SEQ ID NO: 33173
  hemagglutinin__InfluenzaA__AEO01589

SEQ ID NO: 38167 - RNA, 1701 nt, Artificial Sequence; identical to SEQ ID NO: 33173
  hemagglutinin__InfluenzaA__AEO01590

SEQ ID NO: 38168 - RNA, 1701 nt, Artificial Sequence; identical to SEQ ID NO: 33173
  hemagglutinin__InfluenzaA__AEO01591

SEQ ID NO: 38169 - RNA, 1701 nt, Artificial Sequence; identical to SEQ ID NO: 33168
  hemagglutinin__InfluenzaA__AEO01592

SEQ ID NO: 38170 - RNA, 1701 nt, Artificial Sequence
  hemagglutinin__InfluenzaA__AEO01593
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauacugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38171 - RNA, 1701 nt, Artificial Sequence
  hemagglutinin__InfluenzaA__AEO01594
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacgcaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38172 - RNA, 1701 nt, Artificial Sequence; identical to SEQ ID NO: 33168
  hemagglutinin__InfluenzaA__AEO01595

SEQ ID NO: 38173 - RNA, 1701 nt, Artificial Sequence; identical to SEQ ID NO: 37753
  hemagglutinin__InfluenzaA__AEO01596

SEQ ID NO: 38174 - RNA, 1701 nt, Artificial Sequence; identical to SEQ ID NO: 33173
  hemagglutinin__InfluenzaA__AEO01597

SEQ ID NO: 38175 - RNA, 1701 nt, Artificial Sequence
  hemagglutinin__InfluenzaA__AEO01598
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauguuccccaagacaaguucauggcccaaucaugacucgaacaacgguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38176 - RNA, 1701 nt, Artificial Sequence; identical to SEQ ID NO: 33173
  hemagglutinin__InfluenzaA__AEO01599

SEQ ID NO: 38177 - RNA, 1701 nt, Artificial Sequence; identical to SEQ ID NO: 37780
  hemagglutinin__InfluenzaA__AEO01600

SEQ ID NO: 38178 - RNA, 1701 nt, Artificial Sequence
  hemagglutinin__InfluenzaA__AEO01601
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaccagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38179 - RNA, 1701 nt, Artificial Sequence; identical to SEQ ID NO: 33173
  hemagglutinin__InfluenzaA__AEO01602

SEQ ID NO: 38180 - RNA, 1701 nt, Artificial Sequence; identical to SEQ ID NO: 33173
  hemagglutinin__InfluenzaA__AEO01603

SEQ ID NO: 38181 - RNA, 1701 nt, Artificial Sequence; identical to SEQ ID NO: 33173
  hemagglutinin__InfluenzaA__AEO01604

SEQ ID NO: 38182 - RNA, 1701 nt, Artificial Sequence; identical to SEQ ID NO: 38178
  hemagglutinin__InfluenzaA__AEO01605

SEQ ID NO: 38183 - RNA, 1701 nt, Artificial Sequence
  hemagglutinin__InfluenzaA__AEO01606
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaaaaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38184 - RNA, 1701 nt, Artificial Sequence
  hemagglutinin__InfluenzaA__AEO01607
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaggaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38185 - RNA, 1701 nt, Artificial Sequence; identical to SEQ ID NO: 38100
  hemagglutinin__InfluenzaA__AEO01608

SEQ ID NO: 38186 - RNA, 1701 nt, Artificial Sequence
  hemagglutinin__InfluenzaA__AEO01609
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaauucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggagaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaagugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38187 - RNA, 1701 nt, Artificial Sequence
  hemagglutinin__InfluenzaA__AEO01610
augaaggcaauacuaguaguucugcuauauacauuugcaaccacaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaguauguauuuaa

SEQ ID NO: 38188 - RNA, 1701 nt, Artificial Sequence
  hemagglutinin__InfluenzaA__AEO01611
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggagagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggagaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuucuggaugugcucuaaugggucucuacaguguagaauauguauuuaa

SEQ ID NO: 38189 - RNA, 1701 nt, Artificial Sequence
  hemagglutinin__InfluenzaA__AEO01612
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaaggugcaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38190 - RNA, 1701 nt, Artificial Sequence
  hemagglutinin__InfluenzaA__AEO01613
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcguauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaaauuauaugaaaagguaagaagccaguuaaaaaacaaugcuaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38191 - RNA, 1701 nt, Artificial Sequence
  hemagglutinin__InfluenzaA__AEO01614
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaaaagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagaacaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggagauagcaauaagacccaaagugagggaucaagaagggagaaugaacuauuacuggacacuaguagagccgggagacaaaauaacauucgaagcaacuggaaaucuagugguaccgagauaugcauuugcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38192 - RNA, 1701 nt, Artificial Sequence
  hemagglutinin__InfluenzaA__AEO01615
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauacuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacuggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38193 - RNA, 1701 nt, Artificial Sequence; identical to SEQ ID NO: 37955
  hemagglutinin__InfluenzaA__AEO01616

SEQ ID NO: 38194 - RNA, 1701 nt, Artificial Sequence; identical to SEQ ID NO: 34337
  hemagglutinin__InfluenzaA__AEO01617

SEQ ID NO: 38195 - RNA, 1701 nt, Artificial Sequence; identical to SEQ ID NO: 35358
  hemagglutinin__InfluenzaA__AEO01619

SEQ ID NO: 38196 - RNA, 1701 nt, Artificial Sequence
  hemagglutinin__InfluenzaA__AEO01620
augaaggcaauacuaguaguucugcuauauacauuugcaaucgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggaauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcagggaucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauaaaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38197 - RNA, 1701 nt, Artificial Sequence; identical to SEQ ID NO: 38029
  hemagglutinin__InfluenzaA__AEO01621

SEQ ID NO: 38198 - RNA, 1701 nt, Artificial Sequence
  hemagglutinin__InfluenzaA__AEO01625
augaagacuaucauugcuuugagcuacauucuaugucugguuuccgcucaaaaacuuccuggaaaugacaacagcacggcaacacugugccuugggcaccaugcaguaccaaacggaacgauagugaaaacaaucacgaaugaccaaauugaaguuacuaaugcuacugagcugguucagaguuccucaacaggugaaauaugcgacaguccucaucagguccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucaucuggcacacuggaguuuaacaaugaaagcuucaauuggacuggagucacucaaaacggaacaagcucugcuugcauaaggagauccaauaacaguuucuuuaguagacugaauugguugacccacucaaaauucaaauacccagcauugaacgugacuaugccaaacaaugaagaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggauggcugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgagguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38199 - RNA, 1701 nt, Artificial Sequence
  hemagglutinin__InfluenzaA__AEO01636
augaagucuaucauugcuuugagcuacauucuaugucugguuuccgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagguccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucaucuggcacacuggaguuuaacaaugaaagcuucaauuggacuggagucacucaaaacggaacaagcucugcuugcauaaggagaucuaauaacaguuucuuuaguagacugaauugguugacccacucaaaauucaaauacccagcauugaacgugacuaugccaaacaaugaagaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38200 - RNA, 1701 nt, Artificial Sequence
  hemagglutinin__InfluenzaA__AEO01642
augaagacuaucauugcuuugagcuacauucuaugucugguuuccgcucaaaaacuuccugggaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucaucuggcacacuggaguuuaacaaugaaagcuucaauuggacuggagucacucaaaacggaacaagcucugcuugcauaaggagaucuaauaacaguuucuuuaguagacugaauugguugacccacuuaaaauucaaauacccagcauugaacgugacuaugccaaacaaugaagaauuugacaaauuguacauuugggggguucaccacccggguacggacaaugaccaaaucuuccuguaugcucaagcaucaggaagaaucacagucucuaccaaaagaagccaacaaaccguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucuaaaugcaucacuccaaauggaagcauucccaaugacaaaccauuccaaaauguaaacagggucacauacggggccugucccagauaugugaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaauggaaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38201 - RNA, 1698 nt, Artificial Sequence
  hemagglutinin__InfluenzaA__AEO01663
augaaaguaaaacuacugguccuguuaugcacauuugcagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccacaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaagagcaccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucccaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugagauuggaaucaaugggagucuaucagauucuagcgaucuacucaacagucgccaguucucugguucuuuuggucucccugggggcaaucagcuucuggauguguuccaaugggucuuugcaguguagaauaugcaucuaa

SEQ ID NO: 38202 - RNA, 1698 nt, Artificial Sequence
  hemagglutinin__InfluenzaA__AEO01674
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccacaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaaugaaaaucuaaaagccccaagauaugcuuucgcacugaguagaggcuuuggaucaggaaucaucaacucaaaggcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugagauuggaaucaaugggagucuaucagauucuagcgauuuacucaacagucgccaguucucugguucuuuuggucucccugggggcaaucagcuucuggauguguuccaaugggucuuugcaguguagaauaugcaucuaa

SEQ ID NO: 38203 - RNA, 1701 nt, Artificial Sequence
  hemagglutinin__InfluenzaA__AEO01691
augaagacuaucauugcuuugagcuacauucuaugucugguuuccgcucaaaaacuuccuggaaaugacaacagcacggcaacacugugccuugggcaccaugcaguaccaaacggaacgauagugaaaacaaucacgaaugaccaaauugaaguuacuaaugcuacugagcugguucagaguuccucaacaggugaaauaugcgacaguccucaucagguccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucaucuggcacacuggaguuuaacaaugaaagcuucaauuggacuggagucacucaaaacggaacaagcucugcuugcauaaggagauccaauaacaguuucuuuaguagacugaauugguugacccacucaaaauucaaauacccagcauugaacgugacuaugccaaacaaugaagaauuugacaaauuguacauuugggggguucaccacccggguacggacaaugaccaaaucuuccuguaugcucaagcaucaggaagaaucacagucucuaccaaaagaagccaacaaacugugaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucuaaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugauugggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgagguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38204 - RNA, 1698 nt, Artificial Sequence
  hemagglutinin__InfluenzaA__AEO01699
augaaaguaaaacuacugguccuguuaugcacauuuacagcuacauaugcagacacaauauguauaggcuaccaugcuaacaacucgaccgacacuguugacacaguacuugaaaaaaaugugacagugacacacucugucaaccugcuugagaacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccagggauacaauaauauuugaggcaaauggaaaucuaauagcgccaagauaugccuucgcacugaguagaggcuuuggaucaggaaucaucaacucaaaugcaccaauggauaaaugugaugcgaagugccaaacaccucaaggagcuauaaacagcagucuuccuuuccagaacguacacccagucacaauaggagaguguccaaaguaugucaggagugcaaaauuaaggaugguuacaggacuaaggaacaucccauccauuccauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagccuaucagauucuggcgaucuacucaacaggcgccaguucucugguccuuuuggucucccugggggcaaucagcuucuggauguguuccaaugggucuuugcagcguagaauaugcaucuaa

SEQ ID NO: 38205 - RNA, 1698 nt, Artificial Sequence
  hemagglutinin__InfluenzaA__AEO01709
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacacuguaaccggagugucagcaucaugcucccacaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuauguuucuguagugucuucacauuauagcagaaaauucaccccagaaauagccaaaagacccaaauuaagagaucaagauggaagaaucaacuacuacuggacucugcuugaacccggggauacaacaauauuugaggcaaauggaaaucuaauagcaccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauuauaucucaaguguaacggugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucucugcaguguagaauaugcaucuaa

SEQ ID NO: 38206 - RNA, 1701 nt, Artificial Sequence
  hemagglutinin__InfluenzaA__AEO37530
augaaggcaauacuaguaguucugcuauauacauuugcaaccgcaaaugcagacacauuauguauagguuaucaugcgaacaauucaacagauacuguagacacaguacuagaaaagaauguaacaguaacacacucuguuaaccuucuagaagacaagcauaacgggaaacuaugcaaacuaagagggguagccccauugcauuuggguaaauguaacaucgcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaguuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38207 - RNA, 1701 nt, Artificial Sequence
  hemagglutinin__InfluenzaA__AEO72176
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggccuaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuacugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacugguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacuggcagucucccugggggcaaucaguuuuuggaugugcucuaaugggucucuacaguguagaauauguauuuaa

SEQ ID NO: 38208 - RNA, 1704 nt, Artificial Sequence
  hemagglutinin__InfluenzaA__AEO88980
auggagaaaauagugcuucuucuugcaauagucagccuuguuaaaagugaucagauuugcauugguuaccaugcaaacaacucgacagagcagguugacacaauaauggaaaagaacguuacuguuacacaugcccaagacauacuggaaaagacacacaacgggaagcucugcgaucuagacggagugaagccucugauuuuaagagauuguaguguagcuggauggcuccuuggaaacccaaugugugacgaauucaucaaugugccggaauggucuuacauaguggagaaggccaacccagccaaugaccucuguuacccaggaaauuucaacgacuaugaagaacugaaacaccuauugagcagaauaaaccauuuugagaaaauucagaucauccccaaaaguucuugguccgaucaugaagccucaucaggggugagcucagcauguccauaccagggaacgcccuccuuuuucagaaaugugguauggcuuaucaaaaagaacaauacauauccaacaauaaagagaagcuacaauaauaccaaccaggaagaucuuuugauacugugggggauucaucauucuaaugaugcggcagagcagacaaagcucuaucaaaacccaaccaccuauauuuccguugggacaucaacacuaaaccagagauugguaccaaaaauagcuacuagauccaaaguaaacgggcaaaguggaaggauggacuucuucuggacaauuuuaaaaccgaaugaugcaaucaacuucgagaguaauggaaauuucauugcuccagaauaugcauacaaaauugucaagaaaggggacucagcaauuaugaaaagugaaguggaauaugguaacugcaacaccaaaugucaaacuccaauaggggcgauaaacucuaguaugccauuccacaacauacacccucucaccaucggggaaugccccaaauaugugaaaucaaacaaauuaguccuugcgacugggcucagaaauaguccucuaagagaaagaagaagaaaaagaggacuauuuggagcuauagcaggguuuauagagggaggauggcagggaaugguagaugguugguauggguaccaccauagcaaugagcaggggaguggguacgcugcagacaaagaauccacucaaaaggcaauagauggagucaccaauaaggucaacucgaucauugacaaaaugaacacucaguuugaggccguuggaagggaauuuaauaacuuagaaaggagaauagagaauuuaaacaagaaaauggaagacggauuccuagaugucuggacuuauaaugcugaacuucugguucucauggaaaaugagagaacucuagacuuccaugacucaaaugucaagaaccuuuacgacaagguccgacuacagcuuagggauaaugcaaaggagcuggguaacgguuguuucgaguucuaucacaaaugugauaaugaauguauggaaaguguaagaaacggaacguaugacuacccgcaguauucagaagaagcaagauuaaaaagagaggaaauaaguggaguaaaauuggaaucaauaggaacuuaccaaauacugucaauuuauucaacaguugcgaguucucuagcacuggcaaucaugguggcuggucuaucuuuguggaugugcuccaaugggucguuacaaugcagaauuugcauuuaa

SEQ ID NO: 38209 - RNA, 1704 nt, Artificial Sequence
  hemagglutinin__InfluenzaA__AEO89021
auggagaaaauagugcuucuucuugcaauagucagccuuguuaaaagugaucagauuugcauugguuaccaugcaaacaacucgacagagcagguugacacaauaauggaaaagaacguuacuguuacacaugcccaagacauacuggaaaagacacacaacgggaagcucugcgaucuagauggagugaagccucugauuuuaagagauuguaguguagcuggauggcuccucggaaacccaaugugugacgaauucaucaaugugccggaauggucuuacauaguggagaaggccaacccagccaaugaccucuguuacccagggaauuucaacgacuaugaagaacugaaacaccuauugagcagaauaaaccauuuugaaaaaauuccgaucauccccaaaaguucuugguccgaucaugaagccucaucaggggugagcucagcauguccauaccagggaacgcccuccuuuuucagaaaugugguauggcuuaucaaaaagaacaauacauacccaacaauaaagagaagcuacaauaauaccaaccaggaagaucuuuugauacuguggggaauucaucauucuaauaaugcggcagagcagacaaagcucuaucaaaacccaaccaccuauauuuccguugggacaucaacacuaaaccugagauugguaccaaaaauagcuacuagauccaaaguaaacgggcaaaguggaaggauggauuucuucuggacaauuuuaaaaccgaaugaugcaaucaacuucgagaguaauggaaauuucauugcuccagaauaugcauacaaaauugucaagaaaggggacucagcaauuaugaaaagugaaguggaauaugguaacugcaacaccaagugucaaacuccaauaggggcgauaaacucuaguaugccauuccacaacauacacccucucaccaucggggaaugccccaaauaugugaaaucaaacaaauuaguccuugcgacugggcucagaaauaguccucuaagagagagaagaagaaaaagaggacuauuuggagcuauagcaggguuuauagagggaggauggcagggaaugguagaugguugguauggguaccaccauagcaaugagcaggggaguggguacgcugcagacaaagaauccacucaaaaggcaauagauggagucaccaauaaggucaacucgaucauugacaaaaugaacacucaguuugaggccguuggaagggaauuuaauaacuuagaaaggagaauagagaauuuaaacaagaaaauggaagacggauuccuagaugucuggacuuauaaugcugaacuucugguucucauggaaaaugagagaacucuagacuuccaugacucaaaugucaagaaccuuuacgacaagguccgacuacagcuuagggauaaugcaaaggaacuggguaacgguuguuucgaguucuaucacaaaugugauaaugaauguauggaaaguguaagaaacggaacguaugacuacccgcaguauucagaagaagcaagauuaaaaagagaggaaauaaguggaguaaaauuggaaucaauaggaacuuaccaaauacugucaauuuauucaacaguugcgaguucucuagcacuggcaaucaugguggcuggucuaucuuuauggaugugcuccaaugggucguuacaaugcagaauuugcauuuaa

SEQ ID NO: 38210 - RNA, 1704 nt, Artificial Sequence
  hemagglutinin__InfluenzaA__AEO89030
auggagaaaauagugcuucuucuugcaauagucagccuuguuaaaagugaucagauuugcauugguuaccaugcaaacaacucgacagagcagguugacacaauaauggaaaagaacguuacuguuacacaugcccaagacauacuggaaaagacacacaacgggaagcucugcgaucuagauggagugaagccucugauuuuaagagauuguaguguagcuggauggcuccuuggaaacccaaugugugacgaauucaucaaugugccagaauggucuuacauaguggagaaggccaacccagccaaugaccucuguuacccagggaauuucaacgacuaugaagaacuaaaacacuuauugagcagaauaaaccauuuugagaaaauucagaucauccccaaaaguucuuggucagaucaugaagccucaucaggggugagcucaguauguccauaccagggaacgcccuccuuuuucagaaaugugguauggcuuaucaaaaagaacaauacauauccaacaauaaagagaagcuacaauaauaccaaccaggaagaucuuuugauacuguggggaauucaccauucuaaugaugcggcagagcagacaaagcucuaucaaaacccaaccaccuauauuuccguugggacaucaacacuaaaccagagauugguaccaaaaauagcuacuagauccaaaguaaacgggcaaaguggaaggauggauuucuucuggacaguuuuaaaaccgaaugaugcaaucaacuucgagaguaauggaaauuucauugcuccagaauaugcauacaaaauugucaagaaaggggacucagcaauuaugaaaagugaaguggaauaugguaacugcaacaccaagugucaaacuccaauaggggcgauaaacucuaguaugccauuccacaacauacacccucucaccaucggggaaugccccaaauaugugaaaucaaacaaauuaguccuugcgacugggcucagaaauaguccucuaagagaaagaagaagaaaaagaggacuauuuggagcuauagcaggguuuauagagggaggauggcagggaaugguagaugguugguauggauaccaccauagcaaugagcaggggaguggguacgcugcagacaaagaauccacucaaaaggcaauagauggagucaccaauaaggucaacucgaucauugacaaaaugaacacucaguuugaggccguuggaagggaauuuaauaacuuagaaaggagaauagagaauuuaaacaagaaaauggaagacggauuccuagaugucuggacuuauaaugcugaacuucugguucucauggaaaaugagagaacucuagacuuccaugacucaaaugucaagaaccuuuacgacaagguccgacuacagcuuagggauaaugcaaaggagcuggguaacgguuguuucgaguucuaucacaaaugugauaaugaauguauggaaaguguaagaaacggaacguaugacuacccgcaguauucagaagaagcaagauuaaaaagagaggaaauaaguggaguaaaauuggaaucaauaggaacuuaccaaauacugucaauuuauucaacaguugcgaguucucuagcacuggcaaucaugguggcuggucuaucuuuguggaugugcuccaaugggucguuacaaugcagaauuugcauuuaa

SEQ ID NO: 38211 - RNA, 1704 nt, Artificial Sequence
  hemagglutinin__InfluenzaA__AEO89048
auggagaaaauaguguuucuucuugcaauagucagccuuguuaaaagugaucagauuugcauugguuaccaugcaaacaacucgacagagcagguugacacaauaauggaaaagaacguuacuguuacacaugcccaagauauacuggaaaagacacacaacgggaagcucugcgaucuagauggagugaagccucugauuuuaagagauuguaguguagcuggauggcuccucggaaacccaaugugugacgaauucaucaaugugccggaauggucuuacauaguggagaaggccaacccagccaaugaccucuguuacccagggaauuucaacgacuaugaagaacugaaacaccuauugagcagaauaaaccauuuugagaaaauucagaucauccccaaaaguucuugguccgaucaugaagccucaucaggggugagcucagcauguccauaccagggaacgcccuccuuuuucagaaaugugauauggcuuaucaaaaagaacaauacauacccaacaauaaagagaagcuacaauaauaccaaccaggaagaucuuuugauacugugggggauucaucauucuaaugaugcggcagagcagacaaagcucuaucaaaacccaaccaccuauauuuccguugggacaucaacacuuaaccagagauugguaccgaaaauagcuacuagauccaaaguaaacgggcaaaguggaaggauggauuucuucuggacaauuuuaaaaccaaaugaugcaaucaacuucgagaguaauggaaauuucauugcuccagaauaugcauacaaaauugucaagaaaggggacucagcaauucugaaaagugaaguggaauaugguaacugcaacaccaagugucaaacuccaauaggggcgauaaacucuaguaugccauuccacaacauacacccucucaccaucggggaaugccccaaauaugugaaaucaaacaaauuaguccuugcgacugggcucagaaauaguccucuaagagaaagaagaagaaaaagaggacuauuuggagcuauagcagguuuuauagagggaggauggcagggaaugguagaugguugguauggguaccaccauagcaaugagcaggggaguggguacgcugcagacaaagaauccacucaaaaggcaauagauggagucaccaauaaggucaacucgaucauugacaaaaugaacacucaguuugaggccguuggaagggaauuuaauaacuuagaaaggagaauagagaauuuaaacaagaaaauggaagacggauuccuagaugucuggaccuauaaugcugaacuucugguucucauggaaaaugagagaacucuagacuuccaugacucaaaugucaagaaccuuuacgacaagguccgacuacagcuuagggauaaugcaaaggagcuggguaacgguuguuucgaguucuaucacaaaugugauaaugaaugcauggaaaguguaagaaacggaacguaugacuacccgcaguauucagaagaagcaagauuaaaaagagaggaaauaaguggaguaaaauuggaaucaauaggaacuuaccaaauacugucaauuuauucaacaguugcgaguucucuagcacuggcaaucaugguggcuggucuaucuuuauggaugugcuccaaugggucguuacaaugcagaauuugcauuuaa

SEQ ID NO: 38212 - RNA, 1704 nt, Artificial Sequence
  hemagglutinin__InfluenzaA__AEO89065
auggagaaaauagugcuucuucuugcaauagucagccuuguuaaaagugaucagauuugcauugguuaccaugcaaacaacucgacagagcagguugacacaauaauggaaaagaacguuacuguuacacaugcccaagacauacuggaaaagacacacaacgggaagcucugcgaucuagauggagugaagccucugauuuuaagagauuguaguguagcuggauggcuccucggaaacccaaugugugacgaauucaucaaugugccggaauggucuuacauaguggagaaggccaacccagccaaugaccucuguuacccagggaauuucaacgacuaugaagaacugaaacaccuauugagcagaauaaaccauuuugagaaaauucagaucauccccaaaaguucuugguccgaucaugaagccucaucaggggugagcucaguauguccauaccagggaacgcccuccuuuuucagaaaugugguauggcuuaucaaaaagaacaauacauacccaacaauaaagagaagcuacaauaauaccaaccaggaagaucuuuugauacuguggggaauucaucauucuaaugaugcggcagagcagacaaagcucuaucaaaacccaaccaccuauauuuccguugggacaucaacacuaaaccugagauugguaccaaaaauagcuacuagauccaaaguaaacgggcaaaguggaaggauggauuucuucuggacaauuuuaaaaccgagugaugcaaucaacuucgagaguaauggaaauuucauugcuccagaauaugcauacaaaauugucaagaaaggggacucagcaauuaugaaaagugaaguggaauaugguaacugcaacaccaagugucaaacuccaauaggggcgauaaacucuaguaugccauuccacaacauacacccucucaccaucggggaaugccccaaauaugugaaaucaaacaaauuaguccuugcgacugggcucagaaauaguccucuaagagagagaagaagaaaaagaggacuauuuggagcuauagcagguuuuauagagggaggauggcagggaaugguagaugguugguauggguaccaccauagcaaugagcaggggaguggguacgcugcagacaaagaauccacucaaaaggcaauagauggagucaccaauaaggucaacucgaucauugacaaaaugaacacucaguuugaggccguuggaagggaauuuaauaacuuagaaaggagaauagagaauuuaaacaagaaaauggaagacggauuccuagaugucuggacuuauaaugcugaacuucugguucucauggaaaaugagagaacucuagacuuccaugacucaaaugucaagaaccuuuacgacaagguccgacuacagcuuagggauaaugcaaaggaacuggguaacgguuguuucgaguucuaucacaaaugugauaaugaauguauggaaaguguaagaaacggaacguaugacuacccgcaguauucagaagaagcaagauuaaaaagagaggaaauaaguggaguaaaauuggaaucaauaggaacuuaccaaauacugucaauuuauucaacaguugcgaguucucuagcacuggcaaucaugguggcuggucuaucuuuauggaugugcuccaaugggucguuacaaugcagaauuugcauuuaa

SEQ ID NO: 38213 - RNA, 1704 nt, Artificial Sequence
  hemagglutinin__InfluenzaA__AEO89082
auggagaaaauagugcuucuucuugcaauagucagccuuguuaaaagugaucagauuugcauugguuaccaugcaaacaacucgacagagcagguugacacaauaauggaaaagaacguuacuguuacacaugcccaagacauacuggaaaagacacacaacgggaagcucugcgaucuagauggagugaagccucugauuuuaagagauuguaguguagcuggauggcuccucggaaacccaaugugugacgaguucaucaaugugccggaauggucuuacauaguggagaaggccaacccggccaaugaccucuguuacccagggaauuucaacgacuaugaagaacugaaacaccuauugagcagaauaaaccauuuugagaaaauucagaucauccccaaaaguucuugguccgaucaugacaccucaucaggggugagcucagcauguccauaccagggaacgcccuccuuuuucagaaaugugguauggcuuaucaaaaagaacaauacauacccaacaauaaagagaagcuacaauaauaccaacaaggaagaucuuuugauacugugggggauucaucauucuaaugaugcggcagagcagacaaagcucuaucaaaauccaaccaccuauauuuccguugggacaucaacacuaaaccagagauugguaccaaaaauagcuacuagauccaaaguaaacgggcaaaguggaaggauggauuucuucuggacaauuuuaaaaccgaaugaugcaaucaacuucgagaguaauggaaauuucauugcuccagaauaugcauacaaaauugucaagaaaggggacucagcaauuaugaaaagugaaguagaauaugguaacugcaauacaaagugucaaacuccaauaggggcgauaaacucuaguaugccauuccacaacauacacccucucaccaucggggaaugccccaaguaugugaaaucaaacaaauuaguccuugcgacugggcucagaaauaguccucuaagagaaagaagaagaaaaagaggacuauuuggagcuauagcaggguuuauagagggaggauggcagggaaugguagaugguugguauggguaccaccauagcaaugagcaggggaguggguacgcugcagacaaagaauccacucaaaaggcaauagauggagucacaaauaaggucaacucgaucauugacaagaugaacacucaguuugaggcuguuggaagggaauuuaauaacuuagaaagaagaauagagaauuuaaauaagaaaauggaagacggauuccuagaugucuggaccuauaaugcugaacuucugguucucauggaaaaugagagaacucuagacuuccaugacucaaaugucaagaaccuuuacgacaagguucgacuacagcuuagggauaaugcaaaggagcuggguaacgguuguuucgaguucuaucacaaaugugauaaugaauguauggaaaguguaagaaacggaacguaugacuacccgcaguauucagaagaagcaagauuaaaaagagaggaaauaaguggaguaaaauuggaaucaauaggaacuuaccaaauacugucaauuuauucaacaguugcgaguucucuagcacuggcaaucaugguggcuggucuaucuuuguggaugugcuccaaugggucguuacaaugcagaauuugcauuuaa

SEQ ID NO: 38214 - RNA, 1704 nt, Artificial Sequence
  hemagglutinin__InfluenzaA__AEO89091
auggagaaaacaguauuucuucuugcaauagucagccuuguuaaaagugaucagauuugcauugguuaccaugcaaacaacucgacagagcagguugacacaauaauggaaaagaacguuacuguuacacaugcccaaaacauacuggaaaagacacauaacgggaagcucugcgauauagauggagugaagccucugauuuuaaaagauuguaguguagcuggauggcuccucggaaauccaaugugugacgaauucaucaaugugccggaauggucuuacauaguggagaaggccaacccagccaaugaucucuguuacccggggaauuucaacgacuaugaagaacugaaacaccuauugagcagaauaaaucauuuugagaaaauucagaucauccccaaaaguucuugguccgaucaugaagccucaucaggggugagcucaacauguccauaccagggaacgcccucuuuuuucagaaaugugguauggcuuaucaaaaagaacaauacauacccaacaauaaagagaagcuacaauaauaccaaccaggaagaucuuuugauacugugggggauucaucauucuaaugaugaggcagagcaggcaaagcucuaccaaaacccaacuaccuauauuucaguugggacaucaacacuaaaccagagguugguuccaaaaauagcuacuagauccaaaguaaacgggcaaaguggaaggauggauuucuucuggacaauuuuaaaaccgaaugaugcaaucaacuucgagaguaauggaaauuucauugcuccagaauaugcauacaaaauugucaagaaaggggacucagcaauuaugaaaagugaaguggaauaugguaacugcaacaccaagugucaaacuccaauaggggcgauaaacucuaguaugccauuccauaacauacacccucucaccaucggggaaugccccaaauaugugaaaucaaacaaauuaguccuugcgacugggcucagaaauaguccucuaagagaaagaagaagaaaaagaggauuauuuggagcuauagcaggguuuauagagggaggauggcagggaaugguagaugguugguauggguaccaccauagcaaugagcaggggaguggguacgcugcagacaaagaauccacucaaaaggcaauagauggagucaccaauaaggucaacucgaucauugacaaaaugaacacucaguuugaggccguuggaagggaauuuaauaacuuagaaaggagaauagagaauuuaaacaagaaaauggaagacggauuccuagaugucuggacuuauaaugcugaacuucugguucucauggaaaaugagagaacucuagauuuccaugacucaaaugucaagaaccuuuacgacaagguccgacuacagcugagggauaaugcaaaggagcuggggaacgguuguuucgaguucuaucacaaaugugaugaugaauguauggaaaguguaagaaacggaacguaugacuacccgcaguauucagaagaagcaagauuaaaaagagaggaaauaaguggaguaaaauuggaaucaauaggaacuuaccaaauacugucaauuuauucaacaguugcgaguucucuagcacuggcaaucaugauggcuggucuaucuuuguggaugugcuccaaugggucguuacaaugcagaauuugcauuuaa

SEQ ID NO: 38215 - RNA, 1704 nt, Artificial Sequence
  hemagglutinin__InfluenzaA__AEO89100
auggagaaaauagugccuuuucuugcaauaaucagccuuguuaaaagugaucagauuugcauugguuaccaugcaaacaacucgacagagcagguugacacaauaauggagaagaacguuacuguuacacaugcucaagauauacuggaaaagacacacaacgggaaacucugugaucuagauggagugaagccucugauuuuaagagauuguaguguagcuggauggcuccucggaaacccaaugugugacgaauucaucaaugugccggaauggucauacauaguggagaaggccaacccagccaaugaccucuguuacccagggaauuucaacgacuaugaagaacugaaacaccuauuaagcaggauaaaccauuuugagaaaauucagaucauccccaaaaauucuugguccgaucaugaggccucaucaggggugagcucagcauguccauaccagggaacgcccuccuuuuucagaaaugugguauggcuuaucaaaaagaacaauacauacccaacaauaaagagaagcuacaauaauaccaaccaggaagaucuuuugauacugugggggauucaucauucuaaugaugcagcagagcagacaaagcucuaucaaaacccaaccaccuauauuuccguugggacaucaacacugaaccagagauugguaccaaaaauagcuacuagauccaaaguaaacgggcaaaguggaaggauggauuucuucuggacaauuuuaaaaccgaaugaugcaaucaacuucgagaguaauggaaauuucauugcuccagaauaugcauacaaaauugucaagaaaggggacucggcaauuaugaaaagugagguggaguaugguaacugcaacaccaagugucaaacgccaauaggggcgauaaacucuaguaugccauuccacaacauacacccucucaccaucggggaaugccccaaauaugugaaaucaaacaaauuaguccuugcgacugggcucagaaauaguccucuaagagaaagaagaagaaaaagaggacuauuuggagcuauagcagguuuuauagagggcggauggcagggaaugguagaugguugguauggguuucaccauagcaaugagcaggggaguggguacgcugcagacaaagaauccacucaaaaggcaauagauggagucaccaauaaggucaacucaaucaucgacaaaaugaacacucaguuugaggccguuggaagggaauuuaauaacuuagagaggagaauagagaauuuaaacaagaaaauggaagacggauuccuagaugucuggacuuauaaugcugagcuucugguucucauggaaaaugagagaacucuagacuuccaugauucaaaugucaagaaccuuuacgacaagguccgacuacagcuuagggauaaugcaaaggagcuggguaacgguuguuucgaguucuaucacaaaugugaugaugaaugcauggaaaguguaaagaacggaacguaugacuacccgcaguauucagaagaagcaagauuaaaaagagaggaaauaaguggaguaaaauuagaaucaauaggaacuuaccaaauacugucaauuuauucaacaguugcgaguucucuagcacuggcaaucaugguggcuggucuaucuuuauggaugugcuccaaugggucguuacaaugcagaauuugcauuuaa

SEQ ID NO: 38216 - RNA, 1704 nt, Artificial Sequence
  hemagglutinin__InfluenzaA__AEO89109
auggagaaaauagugcuucuucuugcaauagucagccuuguuaaaagugaucagauuugcaucgguuaccaugcaaacaacucgacagagcagguugacacaauaauggaaaagaacguuacuguuacacaugcccaagacauacuggagaagacacauaacgggaaacucugcgaucuagauggagugaagccucugauucuacgagauuguaguguagccggauggcuccucggaaacccaaugugugacgaauucaucaaugugccggaauggucuuacauaguggagaaggccaacccagccaaugaccucuguuacccagggaauuucaacgacuaugaagaacugaaacaccuauugagcagaauaaaccauuuugagaaaauucagaucauccccaaaaguucuugguccgaucaugaagccucaucaggggugagcucagcauguccauaccagggaacgcccuccuuuuucagaaaugugguauggcuuaucaaaaagaacaauacauacccaacaauaaagagaagcuacaauaauaccaaccaggaaaaucuuuugauacugugggggauucaucauucuaaugaugcagcagagcagauaaagcucuaucaaaacccaaccaccuauauuuccguugggacaucaacacuaaaccagagguugguaacaaaaauagccacuagacccaaaguaaacgggcaaaguggaaggauggauuucuucuggacaauuuuaaaaccgaaugaugcaaucaacuucgagaguaauggaaauuucauugcuccagaauaugcauacaaaauugucaaggaaggagacucagcaauuaugaaaagugaaguggaauaugguaacugcaacaccaagugucaaacuccaauaggggcgauaaacucuaguaugccauuccacaacauacacccucucaccaucggggaaugccccaaauaugugaaaucaaacaaauuaguccuugcuacugggcucagaaauaguccucuaagagaaagaagaagaaaaagaggacuauuuggagcuauagcaggguuuauagagggaggauggcagggaaugguagaugguugguauggguaccaccauagcaaugagcaggggaguggguacgcugcagacaaagaauccacucaaaaggcaauagauggagucaccaauaaggucaacucgaucauugacaaaaugaacacucaguuugaggccguuggaagggaauuuaauaaccuggaaaggagaauagagaacuugaacaagaaaauggaagacggauuccuagaugucuggacuuauaaugcugaacuucugguucucauggaaaaugagagaacucuagacuuccaugacucaaaugucaagaaccuuuacgacaagguccgacuacagcuuagggauaaugcaaaggagcuggguaacgguuguuucgaguucuaucacaaaugugauaaugaauguauggaaaguguaagaaacggaacguaugacuacccgcaguauucagaagaagcaagauuaaaaagagaggaaauaaguggaguaaaauuggaaucaauaggaacuuaccaaauacugucaauuuauucaacaguugcgaguucucuagcacuggcaaucaugguggcuggucuaucuuuguggaugugcuccaaugggucguuacaaugcagaauuugcauuuaa

SEQ ID NO: 38217 - RNA, 1704 nt, Artificial Sequence
  hemagglutinin__InfluenzaA__AEO89127
auggagaaaauagugcuucuucuugcaauaaucagccuuguuaaaagugaucagauuugcaucgguuaccaugcaaacaacucgacagagcaaguugacacaauaauggaaaagaacguuacuguuacacaugcccaagacauacuggagaagacacauaacgggaaacucugcgaucuagauggagugaagccucugauucugcgagauuguaguguagcuggauggcuccucggaaacccaaugugugacgaauuuaucaaugugccggaauggucuuacauaguggagaaggccaacccagccaaugaccucuguuacccagggaauuucaacgacuaugaagaacugaaacaccuauugagcagaauaaaccauuuugagaaaauucagaucauccccaaaaguucuugguccgaucaugaagccucaucaggggugagcucagcauguccauaccagggaacgcccuccuuuuucagaaaugugguauggcuuaucaaaaagaacaauacauacccaacaauaaagagaagcuacaauaauaccaaccaggaaaaucuuuugauacugugggggauucaucauucuaaugaugcagcagagcagauaaagcucuaucaaaacccaaccaccuauauuuccguugggacaucaacacuaaaccagagauugguaccaaaaauagccacuagauccaaaguaaacgggcaaaguggaaggauggauuucuucuggacaauuuuaaaaccgaaugaugcaaucaacuucgagaguaauggaaauuucauugcuccagaauaugcauacaaaauugucaaggaaggagacucagcaauuaugaaaagugaaguggaauaugguaacugcaacaccaagugucaaacuccaauaggggcgauaaacucuaguaugccauuccacaacauacacccucucaccaucggggaaugccccaaauaugugaaaucaaacaaauuaguccuugcuacugggcucagaaauaguccucuaagagaaagaagaagaagaagaggacuauuuggagcuauagcaggguuuauagagggaggauggcagggaaugguagaugguugguauggguaccaccauagcaaugagcaggggaguggguacgcugcagacaaagaauccacucaaaaggcgauagauggagucaccaauaaggucaacucaaucauugacaaaaugaacacucaguuugaggccguuggaagggaauuuaauaacuuggaaaggagaauagagaacuuaaacaagaaaauggaagacggauuccuagaugucuggacuuauaaugcugaacuucugguucucauggaaaaugagagaacucuagacuuccaugacucaaaugucaagaaccuuuacgacaagguccgacuacagcuuagggauaaugcaaaggagcuggguaacgguuguuucgaguucuaucacaaaugugauaaugaauguauggaaaguguaagaaacggaacguaugacuacccgcaguauucagaagaagcaagauuaaaaagagaggaaauaaguggaauaaaauuggaaucaaugggaacuuaccaaauacugucaauuuauucaacaguugcgaguucucuagcacuggcaaucaugguggcuggucuaucuuuguggaugugcuccaaugggucguuacaaugcagaauuugcauuuaa

SEQ ID NO: 38218 - RNA, 1704 nt, Artificial Sequence
  hemagglutinin__InfluenzaA__AEO89145
auggagaaaauagugcuucuucuugcaauagucagccuuguuaaaagugaucagauuugcauugguuaccaugcaaacaacucgacagagcagguugacacaauaauggaaaagaacguuacuguuacacaugcccaagauauacuggaaaagacacacaacgggaaacucugcgaucuagauggagugaaaccucugauucuaggagauuguaguguagcuggauggcuccucggaaacccaaugugugacaaauucaucaaugugccggaauggucuuacauaguagagaaggccaauccagccaaugaccucuguuacccagggaauuucaacgacuaugaagaacugaaacaccuauugagcagaauaaaccauuuugagaaaauucagaucauccccaaaaguucuugguccgaucaugaagccucaucaggagugagcucagcauguccauaccagggaacgcccuccuuuuucagaaaugugguauggcucaccaaaaagaacaauacauacccaacaauaaagagaagcuacaauaauaccaaccaggaagaucuuuugauacugugggggauucaucauucuaauaaugcggcagagcaggaaaagcuuuaucaaaacccaaccaccuauauuucaguugggacaucaacacuaaaccagagauugguaccaaaaauagcuacuagauccaaaguaaacgggcaaaguggaaggauggauuucuucuggacaauauuaaaaccaaaugaugcaaucaacuucgagaguaauggaaauuucauugcuccagaauaugcauacaaaauugucaagaaaggagacucagcaauuaugaaaaguggaguggaauaugguaacugcaacacaaagugucaaacuccaauaggggcgauaaacucuaguaugccauuccacaacauacacccucucaccaucggggaaugccccaaauaugugaaaucaaacaaauuaguccuugcgacugggcucagaaauaguccucuaagagaaagaagaagaaaaagaggacuauuuggagcuaucgcagguuuuauagagggaggauggcagggaaugguagaugguugguauggguaccaccauagcaaugagcaggggaguggguacgcugcagacaaagaauccacucaaaaggcaauagauggagucaccaauaaggucaacucgaucauugauaaaaugaacacccaguuugaggcuguuggaagggaauuuaauaacuuagaaaggaggauagaaaauuuaaacaagaaaauggaagacggauuccuagaugucuggacuuauaaugcugaacuucugguucucauggaaaaugagagaacucuagacuuccaugacucaaaugucaagaaccuuuaugacaagguccgacuacagcuuagggauaaugcaaaggagcuggguaaugguuguuucgaguucuaucacaaaugugauaaugaaugcauggaaaguguaagaaauggaacguaugacuacccgcaguauucagaagaagcaagauuaaaaagagaggaaauaaguggaguaaaauuggaaucaauaggaacuuaccaaauacugucaauuuauucuacagcugcgaguucucuagcacuggcaaucaugguggcuggucuaucuuuauggaugugcuccaaugggucguuacaaugcagaauuugcauuuaa

SEQ ID NO: 38219 - RNA, 1707 nt, Artificial Sequence
  hemagglutinin__InfluenzaA__AEO89163
auggagaaaauagugcuucuuuuugcaauagucagccuuguuaaaagcgaucacauuugcauugguuaccaugcaaacaacucgacagagcagguugacacaauaauggaaaagaacguuacuguuacacaugcucaagacauacuggaaaagacacacaacgggaagcucugcgaucuaaauggagugaagccucugauuuuaaaagauuguaguguagcaggauggcuccucgggaacccaaugugugacgaauucaucgaugugccagaauggucuuacauaguagagaaggccaauccagccaaugaccucuguuacccagggaauuucaacgauuaugaagaauugaaacaccuauugagcagaauaaaccauuuugagaaaauacagaucauccccaaagauucuuggccagaucaugaagccucauugggggugagcucagcauguccauaccagggaaauuccuccuuuuucagaaaugugguauggcuuaucaaaaagggcaaugcauacccaacaauaaagaaaagcuacaauaauaccaacaaagaagaucucuugauacugugggggauccaccauccuaaugaugaggcagagcagacaaggcucuaccaaaacccaaccaccuauauuuccauugggacaucaacacuaaaccagagauugguaccaagaauagcuacuagauccaaaguaaacgggcaaaguggaaggauagauuucuucuggacaauuuuaaaaccgaaugaugcaaucaacuucgagaguaauggaaauuucauugcuccagaauaugcauacaaaauugucaagaaaggagacucaacaauuaugaaaagugaaguggaauaugguaacugcaacaccaggugucagacuccgaugggggcgauuaacucuaguaugccauuccacaacauacacccucucaccaucggagaaugucccaaauaugugaaaucaaacaaauuaguccuugcgacugggcucagaaauaguccucaaagagagagaagaagaagaaaaagaggacuguuuggagcuauagcagguuuuauagagggaggauggcagggaaugguagaugguugguauggguaccaccacagcaaugagcaggggaguggguaugcugcagacaaagaauccacucaaaaggcaauagauggagucaccaauaaggucaacucgaucauugacaaaaugaacacucaguuugaagcaguaggaagggaauuuaauaacuuagagaggagaauagagaauuuaaacaagaagauggaagacggauuucuagaugucuggacuuauaaugcugaacuccugguucucauggaaaaugagagaacucuagacuuccaugacucaaaugucaagaaccuuuacgacaaggucagacuacagcuuagggauaaugcaaaagagcuggguaacgguuguuucgaguucuaucacaaaugugauaaugaauguauggaaaguguaagaaacggaacguaugacuacccgcaguauucagaagaagcaagauuaaaaagagaggaaauaaguggaguaaaauuggaaucaauaggaacuuaccaaauacugucaauuuauucaacaguggcgaguucccuaguacuggcaaucaugguugcuggucuaucuuuauggauguguuccaacgggucguuacaaugcagaauuugcauuuaa

SEQ ID NO: 38220 - RNA, 1704 nt, Artificial Sequence
  hemagglutinin__InfluenzaA__AEO89172
auggagaaaauagugcuucuucuugcaauagucagccuuguuagaagugaucagauuugcauugguuaccaugcaaacaacucgacagagcagguugacacaauaauggaaaagaacguuacuguuacacaugcccaaaacauacuggaaaagacacacaacgggaagcucugcgaucuagauggagugaagccuuugauuuuaagagauugcaguguagcuggauggcuccucggaaacccaaugugugacgaauuuaucaaugugccagaauggucuuacauaguggagaaggccaacccagccaaugaccucuguuacccagggaauuucaacgacuaugaagaacugaaacaccuauugagcagaauaaaucauuuugagaaaauucagaucauccccaaaaguucuugguccgaucaugaagccucaucaggggugagcucagcauguccguaucagggaacgcccucuuuuuucaggaauguaguauggcuuaucaaaaagaacaauacauacccaacaauaaagagaagcuacaauaacaccaaccaggaagaucuuuugguacugugggggauucaccauucuaaugaugcgacagaacagauaaagcucuaucaaaacccaaccaccuauguuuccguuggaacaucaacacuaaaccagagauugguaccaaaaauagcuacuagauccaaaguaaacgggcaaaguggaaggauggauuucuucuggacaauuuuaaaaucgaaugaugcaaucaacuucgaaaguaaugggaauuucauugcuccagaauaugcauacaaaauugucaagaaaggggacucagcaauuaugaaaagugaaguggaauaugguaacugcagcaccaagugucaaacuccgauaggggcgauaaacucuaguaugccauuccacaauauacacccucucaccaucggggaaugccccaaauaugugaaaucaaacaaauuaguccuugcgacugggcucagaaauaguccucuaagagaaagaagaagaaaaagaggacuauuuggagcuauagcaggguuuauagagggaggauggcagggaaugguagaugguugguauggguaccaccauaguaaugagcaggggaguggguacgcugcagacaaagaauccacccaaaaggcaauagauggagucaccaauaaggucaacucuaucauugacaaaaugaacacucaguuugaggccguuggaagggaauuuaauaacuuagaaaggagaauagagaauuuaaacaagaaaauggaagacggauuccuagaugucuggacuuauaaugcugaacuucugguucucauggaaaaugagaggacucuagacuuccaugacucaaaugucaagaaccuuuacgacaagguccgacuacagcugagggauaaugcaaaggagcuggguaacgguugcuucgaguucuaucacaaaugugauaaugaauguauggaaaguguaagaaacggaacguaugacuacccgcaguauucagaagaagcaagauuaaaaagagaggaaauuagugggguaaaauuggaaucaauaggaacuuaccaaauacugucaauuuauucaacaguugcgaguucucuagcgcuggcaaucaugguggcuggucuaucuuuguggaugugcuccaaugggucguuacaaugcagaauuugcauuuaa

SEQ ID NO: 38221 - RNA, 1704 nt, Artificial Sequence
  hemagglutinin__InfluenzaA__AEO89181
auggagaaaauagugcuucuuuuugcaacaaucagccuuguuaaaagcgaucauauuugcauugguuaucaugcaaauaacucgacagagcagguugacacaauaauggaaaagaacgugacuguuacacaugcccaagacauacuggaaaagacacacaacgguaagcucugcgaucuaaauggagugaagccucugauuuuaaaagauuguaguguagcaggauggcuccucggaaauccaaugugugacgaauucaucaaugugccagaauggucuuacauaguagagaaggccaauccagccaaugaccucuguuacccagggaauuucaacgauuaugaagaauugaaacaccuauugagcaggauaaaccauuuugagaaaauacagaucauccccaaaaauucuuggucagaucaugaagccucguugggggugagugcagcauguccauaccagggaaaauccuccuucuucagaaaugugguauggcuuaucaaaaaggacaaugcauacccaacaauaaagaaaggcuacaauaauaccaaccaagaagaucucuugguacugugggggauucaccauccuaaugaugaggcagagcagacaaggcucuaucaaaacccaaccaccuauauuuccauugggacaucaacacuaaaccagagauugguaccaaaaauagccacuagguccaaaauaaacgggcaaaguggcaggauagauuucuucuggacaauuuuaaaaccgaaugaugcaauccacuucgagaguaauggaaauuucauugcuccagaauaugcauacaaaauugucaagaaaggagacucaacaauuaugaaaagugaaguggaauaugguaacugcaacaccaggugucagacuccaauaggggcgauaaacuccaguaugccauuccacaacauacacccucucaccaucggagaaugucccaaauaugugaaaucaaacaaacuaguccuugcgacugggcucagaaauaguccucaaagagagagaaggagaaaaagaggauuguuuggagcuauagcagguuuuauagagggaggauggcagggaaugguagaugguugguauggguaccaccacagcaaugagcaggggaguggguacgcugcagacaaagaaucuacucaaaaggcaauagacggggucaccaauaaggucaacucgaucauugacaaaaugaacacucaguuugaggccguaggaagggaauuuaauaacuuagagaggagaauagagaauuugaacaagaagauggaagacggauuccuagaugucuggacuuauaaugcugaacuucugguucucauggaaaaugagagaacucuagacuuccaugacucaaaugucaggaaccuuuacgacaaggucagacuacagcuuaaggauaaugcaaaagagcuggguaacgguuguuucgaguucuaucacaaaugugauaaugaauguauggaaaguguaagaaacggaacguaugacuacccgcaguauucagaagaagcaagauuaaaaagagaggaaauaaguggaguaaaauuggaaucaauaggaaucuaccaaauacugucaauuuauucaacaguggcgaguucccuaguacuggcaaucaugauggcuggucuaucuuuauggauguguuccaacgggucguuacagugcagaauuugcauuuaa

SEQ ID NO: 38222 - RNA, 1704 nt, Artificial Sequence
  hemagglutinin__InfluenzaA__AEO89192
auggagaaaauagugcuucuucuugcaauagucagccuuguuaaaagugaucagauuugcaucgguuaccaugcaaacaacucgacagagcagguugacacaauaauggaaaagaacguuacuguuacacaugcccaagacauacuggaaaagacacauaacgggaagcucugcgaucuagauggagugaagccucuaauuuuaagagauuguaguguagcuggauggcuccucggaaacccaaugugugacgaauucaucaaugugccggaauggucuuacauaguggagaaggccaacccagccaaugaccucuguuacccagggaauuucaacgacuaugaagaacugaaacaccuauugagcagaauaaaccauuuugagaaaauucagaucauccccaaaaguucuugguccgaucaugaagccucaucaggggugagcucagcauguccauaccagggaacgcccuccuuuuucagaaaugugguauggcuuaucaaaaagaacaauacauacccaacaauaaagagaagcuacaauaauaccaaccaggaaaaucuuuugauacugugggggauucaucauucuaaugaugcggcagagcagauaaagcucuaucaaaauccaaccaccuauguuuccauugggacaucaacacuaaaccagagauugguaccaaaaauagccacuagauccaaaguaaacgggcaaagugggaggauggauuucuucuggacaauuuuaaaaccgaaugaugcaaucaacuucgagaguaauggaaauuucauugcuccagaauaugcauacaaaauugucaaggaaggagacucagcaauuaugaaaagugaaguggaauaugguaacugcaacaccaagugucaaacuccaauaggggcgauaaacucuaguaugccauuccacaacauacacccucucaccaucggggaaugccccaaauaugugaaaucaaacaaauuaguccuugcuacugggcucagaaauaguccucuaagagaaagaagaagaaaaagaggacuauuuggagcuauagcaggguuuauagagggaggauggcagggaaugguagaugguugguauggguacccccauagcaaugagcaggggaguggguacgcugcagacaaagaauccacucaaaaggcaauagauggagucaccaauaaggucaacucgaucauugacaaaaugaacacucaguuugaggccguuggaagggaauuuaauaacuuagaaaggagaauagagaauuuaaacaagaaaauggaagauggauuccuagaugucuggacuuauaaugcugaacuucugguucucauggaaaaugagagaacucuagacuuccaugacucaaaugucaagaaucuuuacgacaagguccgauuacagcuuagggauaaugcaaaggagcuggguaacgguuguuucgaguucuaucacaaaugugauaaugaauguauggaaaguguaagaaacggaacguaugacuacccgcaguauucagaagaagcaagguuaaagagagaggaaauaaauggaguaaaauuggaaucaauaggaacuuaccaaauacugucaauuuauucaacaguugcgaguucucuagcacuggcaaucaugguggcuggucuaucuuuguggaugugcuccaaugggucguuacaaugcagaauuugcauuuaa

SEQ ID NO: 38223 - RNA, 1704 nt, Artificial Sequence
  hemagglutinin__InfluenzaA__AEO89203
auggagaaaauagugcuucuucuugcaauagucagccuuguuaaaagugaucagauuugcaucgguuaccaugcaaacaacucgacagagcagguugacacaauaauggaaaagaacguuacuguuacacaugcccaagacauacuggaaaagacacauaacgggaagcucugcgaucuagauggagugaagccucuaauuuuaagagauuguaguguagcuggauggcuccucggaaacccaaugugugacgaauucaucaaugugccggaauggucuuacauaguggagaaggccaacccagccaaugaccucuguuacccagggaauuucaacgacuaugaagaacugaaacaccuauugagcagaauaaaccauuuugagaaaauucagaucauccccaaaaguucuugguccgaucaugaagccucaucaggggugagcucagcauguccauaccagggaacgcccuccuuuuucagaaaugugguauggcuuaucaaaaagaacaauacauacccaacaauaaagagaagcuacaauaauaccaaccaggaaaaucuuuugauacugugggggauucaucauucuaaugaugcggcagagcagauaaagcucuaucaaaauccaaccaccuauguuuccauugggacaucaacacuaaaccagagauugguaccaaaaauagccacuagauccaaaguaaacgggcaaagugggaggauggauuucuucuggacaauuuuaaaaccgaaugaugcaaucaacuucgagaguaauggaaauuucauugcuccagaauaugcauacaaaauugucaaggaaggagacucagcaauuaugaaaagugaaguggaauaugguaacugcaacaccaagugucaaacuccaauaggggcgauaaacucuaguaugccauuccacaacauacacccucucaccaucggggaaugccccaaauaugugaaaucaaacaaauuaguccuugcuacugggcucagaaauaguccucuaagagaaagaagaagaaaaagaggacuauuuggagcuauagcaggguuuauagagggaggauggcagggaaugguagaugguugguauggguaccaccauagcaaugagcaggggaguggguacgcugcagacaaagaauccacucaaaaggcaauagauggagucaccaauaaggucaacucgaucauugacaaaaugaacacucaguuugaggccguuggaagggaauuuaauaacuuagaaaggagaauagagaauuuaaacaagaaaauggaagauggauuccuagaugucuggacuuauaaugcugaacuucugguucucauggaaaaugagagaacucuagacuuccaugacucaaaugucaagaaucuuuacgacaagguccgauuacagcuuagggauaaugcaaaggagcuggguaacgguuguuucgaguucuaucacaaaugugauaaugaauguauggaaaguguaagaaacggaacguaugacuacccgcaguauucagaagaagcaagguuaaagagagaggaaauaaauggaguaaaauuggaaucaauaggaacuuaccaaauacugucaauuuauucaacaguugcgaguucucuagcacuggcaaucaugguggcuggucuaucuuuguggaugugcuccaaugggucguuacaaugcagaauuugcauuuaa

SEQ ID NO: 38224 - RNA, 1704 nt, Artificial Sequence; identical to SEQ ID NO: 38223
  hemagglutinin__InfluenzaA__AEO89213

SEQ ID NO: 38225 - RNA, 1704 nt, Artificial Sequence
  hemagglutinin__InfluenzaA__AEO89224
auggagaaaauagugcuucuucuugcaauagucagccuuguuaaaagugaucagauuugcaucgguuaccaugcaaacaacucgacagagcagguugacacaauaauggaaaagaacguuacuguuacacaugcccaagacauacuggaaaagacacauaacgggaagcucugcgaucuagauggagugaagccucuaauuuuaagagauuguaguguagcuggauggcuccucggaaacccaaugugugacgaauucaucaaugugccggaauggucuuacauaguggagaaggccaacccagccaaugaccucuguuacccagggaauuucaacgacuaugaagaacugaaacaccuauugagcagaauaaaccauuuugagaaaauucagaucauccccaaaaguucuugguccgaucaugaagccucaucaggggugagcucagcauguccauaccagggaacgcccuccuuuuucagaaaugugguauggcuuaucaaaaagaacaauacauacccaacaauaaagagaagcuacaauaauaccaaccaggaaaaucuuuugauacugugggggauucaucauucuaaugaugcggcagagcagauaaagcucuaucaaaauccaaccaccuauguuuccauugggacaucaacacuaaaccagagauugguaccaaaaauagccacuagauccaaaguaaacgggcaaagugggaggauggauuucuucuggacaauuuuaaaaccgaaugaugcaaucaacuucgagaguaauggaaauuucauugcuccagaauaugcauacaaaauugucaaggaaggagacucagcaauuaugaaaagugaaguggaauaugguaacugcaacaccaagugucaaacuccaauaggggcgauaaacucuaguaugccauuccacaacauacacccucucaccaucggggaaugccccaaauaugugaaaucaaacaaauuaguccuugcuacugggcucagaaauaguccucuaagagaaagaagaagaaaaagaggacuauuuggagcuauagcaggguuuauagagggaggauggcagggaaugguagaugguugguauggguaccaccauagcaaugagcaggggaguggguacgcugcagacaaagaauccacucaaaaggcaauagauggagucaccaauaaggucaacucgaucauugacaaaaugaacacucaguuugaggccguuggaagggaauuuaauaacuuagaaaggagaauagagaauuuaaacaagaaaauggaagauggauuccuagaugucuggacuuauaaugcugaacuucugguucucauggaaaaugagagaacucuagacuuccaugacucaaaugucaagaaucuuuacgacaagguccgauuacagcuuagggauaaugcaaaggagcuggguaacgguuguuucgaguucuaucacaaaugugauaaugaauguauggaaaguguaagaaacggaacguaugacuacccgcaguauucagaagaagcaagguuaaagagagaggaaauaaauggaguaaaauuggaaucaauaggaacuuaccaaauacugucaauuuauucaacaguugcgaguucucuagcacuggcaaucaugguagcuggucuaucuuuguggaugugcuccaaugggucguuacaaugcagaauuugcauuuaa

SEQ ID NO: 38226 - RNA, 1704 nt, Artificial Sequence
  hemagglutinin__InfluenzaA__AEO89235
auggagaaaauagugcuucuucuugcaauggucagccuuguuagaagugaucagauuugcauugguuaccaugcaaacaacucgacagagcagguugacacaauaauggaaaagaacguuacuguuacacaugcccaagauauacuggaaaagacacacaacgggaagcucugugaucuagauggagugaagccucugauuuuaagagauuguaguguagcuggauggcuccucggaaacccaaugugugacgaauucaucaaugugccggaauggucuuacauaguggagaaggccaacccagccaaugaccucuguuacccagggaaucucaacgacuaugaagaacugaaacaccuauugagcagaauaaaccauuuugagaaaauucaaaucauccccaaaaguucuugguccgaucaugaagccucauuaggggugagcucagcauguccauaccagggaacacccuccuuuuucagaaaugugauauggcuuaucaagaagaacaauacauacccaacaauaaagagaagcuacaauaauaccaaccaggaagaucuuuugauacugugggggauucaucauucuaaugaugaggcagagcagauaaagcucuaucaaaacccaaccaccuauauuuccguugggacaucaacacuaaaucagagauugguaccaaaaauagcuacuagauccaaaguaaacgggcaaaguggaaggauggauuucuucuggacaauuuuaaaaccggacgaugcaaucaacuucgagaguaauggaaauuucauugcuccagaauaugcauacaaaauugucaagaaaggagacucagcaauuaugaaaagugaaguggaauaugguaacugcaacaccaagugucaaacuccaauaggggcgauaaauucuaguaugccauuccacaacauacacccucucacuaucggggaaugccccaaauaugugaaaucaaacaaauuaguccuugcgacugggcucagaaauaguccucuaagagaaaaaagaagaaaaagaggacuauuuggagcuauagcagguuuuauagagggaggauggcagggaaugguagaugguugguauggguaccaccauagcaaugagcaggggaguggguacgcugcagacaaagaauccacucaaaaggcaauagauggagucaccaauaaggucaacucgaucauugacaaaaugaacacucaguuugaggccguuggaagggaauuuaauaacuuagaaaggagaauagagaauuuaaacaagaaaauggaagacggauuccuagaugucuggacuuauaaugcugaacuucugguucucauggaaaaugagagaacucuagacuuccaugacucaaaugucaagaaccuuuacgacaagguccgacuacagcuuagggauaaugcaaaggaacuggguaacgguuguuucgaguucuaucacaaaugugauaaugaaugcauggaaaguguaagaaacggaacguaugacuacccgcaguauucagaagaagcaagauuaaaaagagaggaaauaaguggaguaaaauuggaaucaauaggaacauaccaaauacugucaauuuauucaacaguugcgaguucucuagcacuggcaaucaugguggcuggucuaucuuuauggaugugcuccaaugggucguuacaaugcagaauuugcauuuaa

SEQ ID NO: 38227 - RNA, 1704 nt, Artificial Sequence
  hemagglutinin__InfluenzaA__AEO89246
auggagaaaauagugccucuucuugcaauggucagccuuguuaaaagugaucagauuugcauugguuaccaugcaaacaacucgacagagcagguugacacaauaauggaaaagaacguuacuguuacacaugcccaagauauacuggaaaagacacacaacgggaagcucugcgaucuagauggagugaagccucugauuuuaagagauuguaguguagcuggauggcuccucggaaacccaaugugugacgaauucaucaaugugccggaauggucuuacauaguggagaaagccaacccagccaaugaccucuguuacccagggaaucucaacgacuaugaagaacugaaacaccuauugagcagaauaaaccauuuugagaaaauucagaucauccccaaaaguucuugguccgaucaugaagccucauuaggagugagcucagcauguccauaccagggaacacccuccuuuuucagaaaugugguauggcuuaucaagaagaacaauacauacccaacaauaaagagaagcuacaauaauaccaaccaggaagaucuuuugauacugugggggauucaucauucuaaugaugaggcagagcagauaaagcucuaucaaaauccaaccaccuauauuuccguugggacaucaacacuaaaccagagauugguuccaaaaauagcuacuagauccaaaguaaacgggcaaaguggaaggauggauuucuucuggacaauuuuaaaaccggacgaugcaaucaacuucgagaguaauggaaauuucauugcuccagaauaugcauacaaaauugucaagaaaggagacucugcaauuaugaaaagugaaguggaauacgguaacugcaacaccaagugucaaacuccaauaggggcgauaaacucuaguaugccauuccacaacauacacccucucacuaucggggaaugccccaaauaugugaaaucaaacaaauuaguccuugcgacugggcucagaaauaguccucuaagagaaagaagaagaaaaagaggacuauuuggagcuauagcagguuuuauagagggaggauggcagggaaugguagaugguugguauggguaccaccauagcaaugagcaggggaguggguacgcugcagacaaagaauccacucaaaaggcaauagauggagucaccaauaaggucaacucgauuauugacaaaaugaacacucaguuugaggccguuggaagggaauuuaguaacuuagaaaggagaauagagaauuuaaacaagaaaauggaagacggguuccuagaugucuggacuuauaaugcugaacuucugguucucauggaaaaugagagaacucuagacuuccaugacucaaaugucaagaaccuuuacgacaagguccgacuacagcuuagggauaaugcaaaggaacuggguaacgguuguuucgaguucuaucacaaaugugauaaugaaugcauggaaaguguaagaaacggaacguaugacuacccgcaguauucagaagaagcaagauuaaaaagagaggaaauaaguggaguaaaauuggaaucaauaggaacuuaccaaauacugucaauuuauucaacaguugcgaguucucuagcacuggcaaucaugguggcuggucuaucuuuauggaugugcuccaaugggucguuacaaugcagaauuugcauuuaa

SEQ ID NO: 38228 - RNA, 1704 nt, Artificial Sequence
  hemagglutinin__InfluenzaA__AEO89257
auggagaaaauagugcuucuucuugcaauagucagccuuguuagaagugaucagauuugcauugguuaccaugcaaacaacucgacagagcagguugacacaauaauggaaaagaacguuacuguuacacaugcccaagacauacuggaaaagacacacaacgggaagcucugcgaucuagauggagugaagccuuugauuuuaagagauuguaguguagcuggauggcuccucggaaacccaaugugugacgaauuuaucaaugugccagaauggucuuacauaguggagaaggccaacccagccaaugaccucuguuacccagggaauuucaacgacuaugaagaacugaaacaccuauugagcagaauaaaucauuuugagaaaauucagaucauccccaaaaguucuugguccgaucaugaagccucaucaggggugagcucagcauguccguaucagggaacgcccucuuuuuucaggaauguaguauggcuuaucaaaaagaacaauacauacccaacaauaaagagaagcuacaauaacaccaaccaggaagaucuuuugguacugugggggauucaccauucuaaugaugcggcagaacagauaaagcucuaucaaaacccaaccaccuauguuuccguuggaacaucaacacuaaaccagagauugguaccaaaaauagcuacuagauccaaaguaaacgggcaaaguggaaggauggauuucuucuggacaauuuuaaaaucgaaugaugcaaucaacuucgagaguaaugggaauuucauugcuccagaauaugcauacaaaauugucaagaaaggggacucagcaauuaugaaaagugaaguggaauaugguaacugcagcaccaagugucaaacuccaauaggggcgauaaacucuaguaugccauuccacaauauacacccucucaccaucggggaaugccccaaauaugugaaaucaaacaaauuaguccuugcgacugggcucagaaauaguccucuaagagaaagaagaagaaaaagaggacuauuuggagcuauagcaggguuuauagagggaggauggcagggaaugguagaugguugguauggguaccaccauaguaaugagcaggggaguggguacgcugcagacaaagaauccacccaaaaggcaauagauggagucaccaauaaggucaacucuaucauugacaaaaugaacacucaguuugaggccguuggaagggaauuuaauaacuuagaaaggagaauagagaauuuaaacaagaaaauggaagacggauuccuagaugucuggacuuauaaugcugaacuucugguucucauggaaaaugagaggacucuagacuuccaugacucaaaugucaagaaccuuuacgacaagguccgacuacagcugagggauaaugcaaaggagcuggguaacgguugcuucgaguucuaucacaaaugugauaaugaauguauggaaaguguaagaaacggaacguaugacuacccgcaguauucagaagaagcaagauuaaaaagagaggaaauuaguggaguaaaauuggaaucaauaggaacuuaccaaauacugucaauuuauucaacaguugcgaguucucuagugcuggcaaucaugguggcuggucuaucuuuguggaugugcuccaaugggucguuacaaugcagaauuugcauuuaa

SEQ ID NO: 38229 - RNA, 1704 nt, Artificial Sequence; identical to SEQ ID NO: 38228
  hemagglutinin__InfluenzaA__AEO89268

SEQ ID NO: 38230 - RNA, 1704 nt, Artificial Sequence
  hemagglutinin__InfluenzaA__AEO89279
auggagaaaauagugcuucuucuugcaauagucagccuuguuaaaagugaucagauuugcauugguuaccaugcaaacaacucgacagagcagguugacacaauaauggaaaagaacguuacuguuacacaugcccaagauauacuggaaaagacacacaacgggaaacucugcgaucuagauggagugaaaccucugauucuaggagauuguaguguagcuggauggcuccucggaaacccaaugugugacaaauucaucaaugugccggaauggucuuacauaguagagaaggccaauccagccaaugaccucuguuacccagggaauuucaacgacuaugaagaacugaaacaccuauugagcagaauaaaccauuuugagaaaauucagaucauccccaaaaguucuugguccgaucaugaagccucaucaggagugagcucagcauguccauaccagggaacgcccuccuuuuucagaaaugugguauggcucaucaaaaagaacaauacauacccaacaauaaagagaagcuacaauaauaccaaccaggaagaucuuuugauacugugggggauucaucauucuaauaaugcggcagagcaggaaaagcuuuaucaaaacccaaccaccuauauuucaguugggacaucaacacuaaaccagagauugguaccaaaaauagcuacuagauccaaaguaaacgggcaaaguggaaggauggauuucuucuggacaauauuaaaaccaaaugaugcaaucaacuucgagaguaauggaaauuucauugcuccagaauaugcauacaaaauugucaagaaaggagacucagcaauuaugaaaaguggagugaaauaugguaacugcaacacaaagugucaaacuccaauaggggcgauaaacucuaguaugccauuccacaacauacacccucucaccaucggggaaugccccaaauaugugaaaucaaacaaauuaguccuugcgacugggcucagaaauaguccucuaagagaaagaagaagaaaaagaggacuauuuggagcuaucgcagguuuuauagagggaggauggcagggaaugguagaugguugguauggguaccaccauagcaaugagcaggggaguggguacgcugcagacaaagaauccacucaaaaggcaauagauggagucaccaauaaggucaacucgaucauugauaaaaugaacacccaguuugaggcuguuggaagggaauuuaauaaccuagaaaggaggauagaaaauuuaaacaagaaaauggaagacggauuccuagaugucuggacuuauaaugcugaacuucugguucucauggaaaaugagagaacucuagacuuccaugacucaaaugucaagaaccuuuaugacaagguccgacuacagcuuagggauaaugcaaaggagcuggguaaugguuguuucgaguucuaucacaaaugugauaaugaaugcauggaaaguguaagaaauggaacguaugacuacccgcaguauucagaagaagcaagauuaaaaagagaggaaauaaguggaguaaaauuggaaucaauaggaacuuaccaaauacugucaauuuauucuacagcugcgaguucucuagcacuggcaaucaugguggcuggucuaucuuuauggaugugcuccaaugggucguuacaaugcagaauuugcauuuaa

SEQ ID NO: 38231 - RNA, 1704 nt, Artificial Sequence
  hemagglutinin__InfluenzaA__AEO89289
auggagaaaauagugcuucuucuugcaauagucagccuugcuaaaagugaucagauuugcauugguuaccaugcaaacaacucgacagagcagguugacacaauaauggaaaagaacguuacuguuacacaugcccaggauauacuggaaaagacacacaacgggaaacucugcgaucuagauggagugaaaccucugauuuuaggagauuguaguguagcuggauggcuccuaggaaauccaaugugugacaaauucaucaaugugccggaauggucuuacauaguagagaaggucaauccagccaaugaccucuguuacccagggaauuucaacgacuaugaagaacugaaacaccuauugagcagaauaaaccauuuugagaaaauuaagaucauccccaaaaguucuugguccgaucaugaagccucaucaggagugagcucagcauguccauaccagggaacgcccuccuuuuucagaaaugugguguggcucaucaaaaagaacaauacauacccaacaauaaagagaagcuacaauaauaccaaccaggaagaucuuuugauacugugggggauucaucauucuaauaauguggcagagcaggaaaagcuuuaucaaaacccaaccaccuacauuucaguugggacaucaacacuaaaccagagauugguaccaaaaauagcuacuagauccaaaguaaacgggcaaaguggaaggauggauuucuucuggacaauauuaaaaccaaaugauacaaucaacuucgagaguaauggaaauuucauugcuccagaauaugcauacaaaauugucaagaaaggagacucagcaauuaugaaaaguggaguggaauaugguaacugcaacacaaagugucaaacuccaauaggggcgauaaacucuaguaugccauuccacaacauacacccucucaccaucggggaaugccccaaauaugugaaaucaaacaaauuaguccuugcgacugggcucagaaauaguccucuaagagaaagaagaagaaaaagaggacuauuuggagcuaucgcagguuuuauagagggaggauggcagggaaugguagaugguugguauggguaccaccauagcaaugagcaggggaguggguacgcugcagacaaagaauccacucaaaaggcaauagauggagucaccaauaaggucaacucgaucauugauaaaaugaacacccaguuugaggcuguuggaagggaauuuaauaacuuagaaaggaggauagaaaauuuaaacaagaaaauggaagacggauuccuagaugucuggacuuauaaugcugaacuucugguucucauggaaaaugagagaacucuagacuuccaugacucaaaugucaagaaccuuuaugacaagguccgacuacagcuuagggauaaugcaaaggagcuggguaaugguuguuucgaguucuaucacaaaugugauaaugaaugcauggaaaguguaagaaauggaacguaugacuacccgcgguauucagaagaagcaagauuaaaaagagaggaaauaaguggaguaaaauuggaaucaauaggaacuuaccaaauacugucaauuuauucuacagcugcgaguucucuagcacuggcaaucaugguggcuggucuaucuuuauggaugugcuccaaugggucguuacaaugcagaauuugcauuuaa

SEQ ID NO: 38232 - RNA, 1704 nt, Artificial Sequence
  hemagglutinin__InfluenzaA__AEO89300
auggagaaaauagugcuucuucuugcaauagucagccuuguuaaaagugaucagauuugcaucgguuaccaugcaaacaacucgacagagcagguugacacaauaauggaaaagaacguuacuguuacacaugcccaagacauacuggagaagacacauaacgggaaacucugcgaucuagauggagugaagccucugauucuacgagauuguaguguagcuggauggcuccucggaaacccaaugugugacgaauucaucaaugugccggaauggucuuacauaguggagaaggccaacccagccaaugaccucuguuacccagggaauuucaacgacuaugaagaacugaaacaccuauugagcagaauaaaccauuuugagaaaauucagaucauccccaaaaguucuugguccgaucaugaagccucaucaggggugagcucagcauguccauaccagggaacgcccuccuuuuucagaaaugugguauggcuuaucaaaaagaacaauacauacccaacaauaaagagaagcuacaauaauaccaaccaggaaaaucuuuugauacugugggggauucaucauucuaaugaugcagcagagcagauaaagcucuaucaacacccaaccacuuauauuuccguugggacaucaacacuaaaucagagauugguaccaaaaauagccacuagauccaaaguaaacgggcaaaguggaaggauggauuucuucuggacaauuuuaaagccgaaugaugcaaucaauuucgagaguaauggaaauuucauugcuccagaauaugcauacaaaauugucaaggagggagacucagcaauuaugaaaagugaaguggaauaugguaacugcaacaccaagugucaaacuccaauaggggcgauaaacucuaguaugccauuccacaacauacacccucucaccauuggggaaugccccaaauaugugaaaucaaacaaauuaguccuugcuacugggcucagaaauaguccucuaagagaaagaagaagaaaaagaggacuauuuggagcuauagcaggguuuauagagggaggauggcagggaaugguagaugguugguauggguaccaccauagcaaugagcaagggaguggguacgcugcagacaaagaauccacucaaaaggcaauagauggagucaccaauaaggucaacucaaucauugacaaaaugaacacucaguuugaggccguuggaagggaauuuaauaacuuggaaaggagaauagagaacuuaaacaagaaaauggaagacggauuccuagaugucuggacuuauaaugcugaacuucugguucucauggaaaaugagagaacucuagacuuccaugacucaaaugucaagaaccuuuacgacaagguccgacuacagcuuagggauaaugcaaaggagcuggguaacgguuguuucgaguucuaucacaaaugugauaaugaauguauggaaaguguaagaaacggaacguaugacuacccgcaguauucagaagaagcaagauuaaaaagagaggaaauaaauggaguaaaauuggaaucaaugggaacuuaccaaauacugucaauuuauucaacaguugcgaguucucuagcacuggcaaucaugguggcuggucuaucuuuuuggaugugcuccaaugggucguuacaaugcagaauuugcauuuaa

SEQ ID NO: 38233 - RNA, 1704 nt, Artificial Sequence
  hemagglutinin__InfluenzaA__AEO89311
auggagaaaauagugcuucuuuuugcaauagucagccuuguuaaaagcgaucauauuugcauugguuaucaugcaaacaacucgacagagcagguugacacaauaauggaaaagaacguuacuguuacacacgcccaagacauacuggaaaagacacacaacgggaagcucugcgaucuaaauggagugaagccucugauuuuaaaagauuguaguguagcaggauggcuccucggaaacccaaugugugacgaauucaucaaugugccagaauggucuuacauaguagagaaggccaauccagccaaugaccucuguuacccagggaauuucaacgauuaugaagaauugaaacaccuauugagcaggauaaaccauuuugagaaaauacagaucauccccaaagauucuuggucagaucaugaagccucauugggggugagcgcagcauguccauaccagggaaauuccucauucuucagaaaugugguauggcuuaucaaaaaggacaaugcauacccaacaauaaagaaaagcuacaauaauaccaaccaagaagaucucuugauacugugggggauucaccauccuaaugaugaggcagagcagacaaggcucuaucaaaacccaaccaccuauauuuccauugggacaucaacacuaaaccagagauugguaccaaaaauagccacuagauccaaaguaaacgggcaaaguggaaggauagauuucuucuggacaauuuuaaaaccgaaugaugcaauccacuucgagaguaauggaaauuucauugcuccagaauaugcauacaaaauugucaagaaaggagacucaacaauuaugaaaagugaaguggaauaugguaacugcaacaccaggugucagacuccgaugggggcgauaaacucuaguaugccauuccacaacauacacccucucaccaucggagaaugucccaaauaugugaaaucaaccaaauuaguccuugcgacugggcucagaaauaguccucaaagagagagaagaagaaaaagaggacuguuuggagcuauagcagguuuuauagagggaggauggcagggaaugguagaugguugguauggguaccaccacagcaaugagcaggggaguggguacgcugcagacaaagaauccacucaaaaggcaauagacggagucaccaauaaggucaacucgaucauugacaaaaugaacacucaguuugaggccguaggaagagaauuuaauaaauuagagaggagaauagagaauuuaaacaagaagauggaagacggauuccuagaugucuggacuuauaaugcugaacuucugguucucauggaaaaugagagaacucuagacuuccaugacucaaaugucaagaaccuuuacgacaaggucagacuacagcuuagggauaaugcaaaagagcuggguaacgguuguuucgaguucuaucacaaauguaauaaugaauguauggaaaguguaagaaacggaacguaugacuacccgcaguauucagaagaagcaagauuaaaaagagaggaaauaaguggaguaaaauuggaaucaauaggaauuuaccaaauacugucaauuuauucaacaguggcgaguucccuaguacuggcaaucaugauggcuggucuaucuuuauggauguguuccaacgggucguuacagugcagaauuugcauuuaa

SEQ ID NO: 38234 - RNA, 1701 nt, Artificial Sequence; identical to SEQ ID NO: 32472
  hemagglutinin__InfluenzaA__AEO99215

SEQ ID NO: 38235 - RNA, 1698 nt, Artificial Sequence
  hemagglutinin__InfluenzaA__AEQ38187
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauugaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagcgucagcaucaugcucccauaauggggaaaacaguuuuuacagaaauuugcuauggcugacggggaagaaugguuuguacccaaaccugagcaaguccuaugcaaacaacaaagaaaaagaaguccuuguacuaugggguguucaucacccgccaaacauagcugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacuuugcuugaacccggggauacaauaauauuugaggcaaauggaaaucuaauagcgccaagauaugcuuucgcacugaguaggggcuuuggaucaggaaucaucaacucaaaugcaccaauggauaaaugugaugcgaagugccaaacaccucaaggagcuauaaacagcagucuuccuuuccagaacgugcacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauacaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaagugcaacgaugaaugcauggagaguguaaagaauggaacuuaugacuauccaaaauauuccgaagaaucaaaguuaaacagggagaaaauugauggaguuaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38236 - RNA, 1698 nt, Artificial Sequence
  hemagglutinin__InfluenzaA__AEQ38188
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagcgucagcaucaugcucccauaauggggaaaacaguuuuuacagaaauuugcuauggcugacggggaagaaugguuuguacccaaaccugagcaaguccuaugcaaacaacaaagaaaaagaaguccuuguacuaugggguguucaucacccgccaaacauagcugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguaggggcuuuggaucaggaaucaucaacucaaaugcaccaauggauaaaugugaugcgaagugccaaacaccucaaggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaacaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38237 - RNA, 1698 nt, Artificial Sequence
  hemagglutinin__InfluenzaA__AEQ38189
augaaaguaaaacuacugguccuguuaugcacauuuacagcuacauaugcagacacaauauguauaggcuaccaugcuaacaacucgaccgacacuguugacacaguacuugaaaagaaugugacagugacacauucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaaacaguuuuuacagaaauuugcuauggcugacggggaagaaugguuuguacccaaaccugagcaaguccuaugcaaacaacaaagaaaaagaaguccuuguacuaugggguguucaucacccgccaaacauagcuaaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucaaggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugaaaaaaugaacacucaauucacagcagugggcaaagaauucaacaaauuggaaagaaggauggaaaacuugaauaaaaaaguugaugauggauuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucucuuggucucccugggggcaaucagcuucuggauguguuccaaugggucuuugcaguguagaauaugcaucuaa

SEQ ID NO: 38238 - RNA, 1698 nt, Artificial Sequence
  hemagglutinin__InfluenzaA__AEQ38190
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcaguguugccggguggaucuuaggaaacccagaaugcgaauuacugauuuccaaggagucaugguccuacauuguagaaaaaccgaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaaacaguuucuacagaaauuugcuauggcugacggggaagaaugguuuguacccaaaccugagcaagcccuaugcaaacaacaaagaaaaagaaguccuuguacuaugggguguucaucacccgccaaacauagcuguccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucaaggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggauuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucucuuggucucccugggggcaaucagcuucuggauguguuccaaugggucuuugcaguguagaauaugcaucuaa

SEQ ID NO: 38239 - RNA, 1698 nt, Artificial Sequence
  hemagglutinin__InfluenzaA__AEQ38191
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaaacaguuuuuacagaaauuugcuauggcugacggggaagaaugguuuguacccaaaccugagcaaguccuaugcaaacaacaaagaaaaagaaguccuuguacuaugggguguucaucacccgccaaacauagcugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucaaggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggauuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucucuuggucucccugggggcaaucagcuucuggauguguuccaaugggucuuugcaguguagaauaugcaucuaa

SEQ ID NO: 38240 - RNA, 1698 nt, Artificial Sequence
  hemagglutinin__InfluenzaA__AEQ38192
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaagcauaagugaccaaaagacccucuaucauacagaaaaugcuuauguuucuguagugucuucacauuauagcagaaaauucaccccagaaauaaccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaauacaccaauggauaaaugugauacgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacccaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38241 - RNA, 1698 nt, Artificial Sequence
  hemagglutinin__InfluenzaA__AEQ38193
augaaaguaaaacuacugauccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaagagucauggucauacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaaucugcuauggcugacggggaagaaugguuuguacccaaaccugagcaaguccuaugcaaacaacaaagaaaaagaaguccuuguacuaugggguguucaucacccgccaaacauaguugaccaaaagacccucuaucguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcaaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38242 - RNA, 1698 nt, Artificial Sequence
  hemagglutinin__InfluenzaA__AEQ38194
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaagcauaagugaccaaaagacccucuaucauacagaaaaugcuuauguuucuguagugucuucacauuauagcagaaaauucaccccagaaauagccaaaagacccaaaguaagagaucaagaaggaagaaucaacuacuauuggacucugcuugaacccggggauacaauaauauuugaggcaaguggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagacgguugguaugguuaucaucaucggaaugagcaaggaucuggcuaugcugcagaucaaaaaagcacacaaaaugccauuaaugggauuacaaacaaggugaauucuguaauugagaaaaugaacacucaauucacagcagugggcaaagaauucaauaaauuggaaagaaggauggaaaacuugaauaaaagaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucgaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38243 - RNA, 1698 nt, Artificial Sequence
  hemagglutinin__InfluenzaA__AEQ38195
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaagggauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagcgucagcaucaugcucccauaauggggaaaacaguuuuuacagaaauuugcuauggcugacggggaagaaugguuuguacccaaaccugagcaaguccuaugcaaacaacaaagaaaaagaaguccuuguacuaugggguguucaucacccgccaaacauagcuaaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaagcaaauggaaaucuaauagcgccaagauaugcuuucgcacugaguaggggcuuuggaucaggaaucaucaacucaaaugcaccaauggauaaaugugaugcgaagugccaaacaccucaaggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcaaugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaagugcaacgaugaaugcauggagaguguaaagaauggaacuuaugacuauccaaaauauuccgaagaaucaaaauuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38244 - RNA, 1698 nt, Artificial Sequence
  hemagglutinin__InfluenzaA__AEQ38196
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaggaaagcucauggcccaaccacaccguaaccggagcgucagcaucaugcucccauaauggggaaaacaguuuuuacagaaauuugcuauggcugacggggaagaaugguuuguacccaaaccugagcaaguccuaugcaaacaacaaagaaaaagaaguccuuguacuaugggguguucaucacccgccaaacauagcugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguaggggcuuuggaucaggaaucaucaacucaaaugcaccaauggauaaaugugaugcgaagugccaaacaccucaaggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugaauauccaaaauauuccgaagaaucaaaguuaaacagggagaaaauugauggagugaaauuggaaucaaugggagucuaucagauucuggcgaucuacucaacagucgcaaguucucugguucuuuuggucucccugggggcaaucagcuucuggauguguuccaaugggucuuugcaguguagaauaugcaucuaa

SEQ ID NO: 38245 - RNA, 1698 nt, Artificial Sequence
  hemagglutinin__InfluenzaA__AEQ38197
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaagggauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagcgucagcaucaugcucccauaauggggaaaacaguuuuuacagaaauuugcuauggcugacggggaagaaugguuuguacccaaaccugagcaaguccuaugcaaacaacaaagaaaaagaaguccuuguacuaugggguguucaucacccgccaaacauagcugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguaggggcuuuggaucaggaaucaucaacucaaaugcaccaauggauaaaugugaugcgaagugccaaacaccucaaggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaagugcaacgaugaaugcauggagaguguaaagaauggaacuuaugacuauccaaaauauuccgaagaaucaaaauuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38246 - RNA, 1698 nt, Artificial Sequence
  hemagglutinin__InfluenzaA__AEQ38198
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagcgucagcaucaugcucccauaauggggaaaacaguuuuuacagaaauuugcuauggcugacggggaagaaugguuuguauccaaaucugagcaaguccuaugcaaacaacaaagaaaaagaaguccuuguacuaugggguguucaucacccgccaaacauagcugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguaggggcuuuggaucaggaaucaucaacucaaaugcaccaauggauaaaugugaugcgaagugccaaacaccucaaggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 38247 - RNA, 1701 nt, Artificial Sequence
  hemagglutinin__InfluenzaA__AEQ62909
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacugagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaagagcuaagagagcaauugagcucagugucaucauuugaaagguuugagauauucccaaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuauauuaacgauaaagggaaagaaguccuagugcuauggggcauucaccauccaucuacuagugcugaccaacaaagucucuaucagaaugcagaugcauauguuuuuguggggacaucaaaauacagcaagaaguucaagccggaaauagcaguaagaccuaaagugagggaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacgggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaaaaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38248 - RNA, 1701 nt, Artificial Sequence
  hemagglutinin__InfluenzaA__AEQ62910
augaaggcaauacuaguaguuaugcuauauacauuugcaaccgcaaaugcagacacacuaugcauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacagcuaguccagacaauggaacguguuacccaggagauuucaucgauuaugaggagcuaagagagcaauugagcucagugucaucauuugaaagguuugaaauauuucccaagacaaguucauggcccaaucaugacucgaacaaagguguaacggcagcauguccucaugcgggagcaaaaagcuucuacaaaaauuuaauguggcuaguuaaaaaaggaaauucauacccaaagcucagcaaauccuacauuaaugauaaagggaaagaaguccucgugcuauggggcauucaccauccaccuacuagugcugaccaacaaagucucuaucagaaugcagaugcauauguuuuuguggggacaucaagauacagcaagaaguucaaaccggaaauagcaauaagacccaaagugaggggucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagucacccaagggugccauaaacaccagccucccauuucagaauauacauccgaucacaauuggagaauguccaaaauauguaaaaagcacaaaauugagacuggccacaggauugaggaaugucccgucuguucaaucuagaggccuauuuggggccauugccgguuucauugaagggggguggacagggaugguagauggaugguacgguuaucaccaucaaaaugaacaggggucaggauaugcagccgaccugaagagcacacagaaugcuauugacgagauuacuaacaaaguaaauucuguuauugaaaagaugaauacacaguucacagcaguagguaaagaguucaaucaacuggaaaaaagaauagagaauuuaaauaaaaaaguugaugaugguuuccuggacauuuggacuuacaaugccgaacuguugguucuauuagaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagauggaguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38249 - RNA, 1701 nt, Artificial Sequence
  hemagglutinin__InfluenzaA__AEQ62911
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuaguggugccgagauaugcauucgcaauggaaagaaaugcuggaucugguauuaucauuucagauacaccaguccacgauugcaauacaacuugucagacacccaagggugccauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38250 - RNA, 1701 nt, Artificial Sequence; identical to SEQ ID NO: 38247
  hemagglutinin__InfluenzaA__AEQ62912

SEQ ID NO: 38251 - RNA, 1701 nt, Artificial Sequence
  hemagglutinin__InfluenzaA__AEQ62915
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuacugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuaguggugccgagauaugcauucgcaauggaaagaaaugcuggaucugguauuaucauuucagauacaccaguccacgauugcaauacaacuugucagacacccaagggugccauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaaaccaguuaaaaaccaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38252 - RNA, 1701 nt, Artificial Sequence; identical to SEQ ID NO: 34103
  hemagglutinin__InfluenzaA__AER08646

SEQ ID NO: 38253 - RNA, 1701 nt, Artificial Sequence
  hemagglutinin__InfluenzaA__AER08648
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacccaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaacucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaaggggguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38254 - RNA, 1701 nt, Artificial Sequence
  hemagglutinin__InfluenzaA__AER08652
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcaggauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccagugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaggaauucucagaagucgaagggaggauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcacuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38255 - RNA, 1701 nt, Artificial Sequence; identical to SEQ ID NO: 38254
  hemagglutinin__InfluenzaA__AER08654

SEQ ID NO: 38256 - RNA, 1701 nt, Artificial Sequence
  hemagglutinin__InfluenzaA__AER08656
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcuuguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccgaacaaugaacaauuugacaaauuguacauuugggggguucaccacccggguacggacaaagaccaaaucuuccuguaugcucaagcaucaggaagaaucacagucucuaccaaaagaagccaacaaacuguaaucccgaauaucggaucuagaccccgaguaaggaauaucccuagcagaauaagcaucuauuggacaauaguaaaaccgggagacauacuuuugauuaacagcacagggaaucuaauugcuccuagggguuacuucaaaaugcaaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38257 - RNA, 1701 nt, Artificial Sequence
  hemagglutinin__InfluenzaA__AER08660
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38258 - RNA, 1701 nt, Artificial Sequence
  hemagglutinin__InfluenzaA__AER08664
augaagacuaucauugcuuugagcuacauucuaugccugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacagugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuugagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 38259 - RNA, 1701 nt, Artificial Sequence
  hemagglutinin__InfluenzaA__AER08668
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuugaacuucaaauacccagcauugaacgugaccaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagauauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucgaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcucuguugggguucaucaugugggccugccaaaaaggcaacauuaggugcaacauuugcauuuga

SEQ ID NO: 38260 - RNA, 1701 nt, Artificial Sequence
  hemagglutinin__InfluenzaA__AER08670
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuugaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagauauacuuuugauuaacagcacagggaaucuaauugcuccuagggguuacuucaaaauacgaagugggaaaagcucaauaaugaaaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguagaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucggaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucgaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcucuguugggguucaucaugugggccugccaaaaaggcaacauuaggugcaacauuugcauuuga

SEQ ID NO: 38261 - RNA, 1701 nt, Artificial Sequence
  hemagglutinin__InfluenzaA__AER08672
augaagacuaucauugcuuugagcuacauucuauguuugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggaggaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacagugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuugagaaccaacauacaauugaucuaacugacucagaaaugaacaaacuguuugaaaaaacaaagaaacaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38262 - RNA, 1701 nt, Artificial Sequence
  hemagglutinin__InfluenzaA__AER08674
augaagacuaucauugcuuugagcuacauucuaugucugguuuucgcucaaaaacuuccuggaaaugacaacagcacggcaacgcugugccuugggcaccaugcagugccaaacggaacgauggugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuugaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagauauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuucaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38263 - RNA, 1701 nt, Artificial Sequence
  hemagglutinin__InfluenzaA__AER08676
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauucggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38264 - RNA, 1701 nt, Artificial Sequence
  hemagglutinin__InfluenzaA__AER08678
augaagaccaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38265 - RNA, 1701 nt, Artificial Sequence
  hemagglutinin__InfluenzaA__AER08680
augaagacuaucauugcuuugagcuacauucuaugucugguuuucgcccaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucagcaggugaaauaugcgacaguccucaucagauccuugauggagaaaacugcacacuaauagaugcucuauugggagacccucagugugauggcuuccaaaauaagaaaugggaccuuuuuguugaacgaagcagagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugauggaugguugguacgguuucaggcaucaaaauucugagggaagaggacaagcagcagaucucaaaagcacucaagcagcaaucgaucaaaucaauggaaagcugaauagauugaucgggaaaaccaacgagaaauuccaucagauugaaaaagaauucucagaagucgaagggagaauucaggaucuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38266 - RNA, 1701 nt, Artificial Sequence
  hemagglutinin__InfluenzaA__AER08682
augaagacugucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38267 - RNA, 1701 nt, Artificial Sequence
  hemagglutinin__InfluenzaA__AER08684
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauuaaauugguugacccacuuaaacuucaaauacccagcauugaacgugacuaugccaaacaaugaacaauuugacaaauuauacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucuacaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggaacuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38268 - RNA, 1701 nt, Artificial Sequence
  hemagglutinin__InfluenzaA__AER08686
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuauacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucuacaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauauugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38269 - RNA, 1701 nt, Artificial Sequence
  hemagglutinin__InfluenzaA__AER08688
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaguucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38270 - RNA, 1701 nt, Artificial Sequence
  hemagglutinin__InfluenzaA__AER08690
augaagacuaucauugcuuugagcuacauucuaugucugguuuucgcucaaaaacuuccugaaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuauacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugaucaacagcacagggaaucuaauugcuccuagggguuacuucaaaauacgaagugggaaaagcucaauaaugagaucagaugcacccauuggcaaaugcaauucuacaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaaccuaugaccacgauguguacagagaugaagcauuaaacaaccgauuccagaucaagggaguugagcugaagucaggguacaaagauuggauccuauggauuuccuuugccauaucauguuuuuugcuuuguguuguuuuguugggguucaucaugugggccugccaaaaaggcaacauuaggugcaacauuugcauuuga

SEQ ID NO: 38271 - RNA, 1701 nt, Artificial Sequence
  hemagglutinin__InfluenzaA__AER08692
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccccaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggcaugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38272 - RNA, 1701 nt, Artificial Sequence
  hemagglutinin__InfluenzaA__AER08698
augaagacuaccauugcuuugagccacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagagcuccucagcaggugaaauaugcgacaguccucaucagauccuugauggagaaaacugcacacuaauagaugcucuauugggagacccucagugugauggcuuccaaaauaagaaaugggaccuuuuuguugaacgaagcagagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaauggaaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38273 - RNA, 1701 nt, Artificial Sequence
  hemagglutinin__InfluenzaA__AER08700
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauuggcugacccacuugaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagauauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaaacaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucgaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcucuguugggguucaucaugugggccugccaaaaaggcaacauuaggugcaacauuugcauuuga

SEQ ID NO: 38274 - RNA, 1701 nt, Artificial Sequence
  hemagglutinin__InfluenzaA__AER92712
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguugaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaauucagacaauggaacguguuacccaggagauuucaucgauuaugaggagcuaagagagcaauugagcucagugucaucauuugaaagguuugaaauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucaacaaauccuacauuaaugauaaaggaaaagaaguccucgugcuauggggcauucaccauccaucuacuaguacugaccaacaaagucucuaucagaaugcagaugcauauguuuuuguggggacaucaagauacagcaagaaguuuaagccggaaauagcaauaagacccaaagugaggaaucaagaagggagaaugaacuauuacuggacacuaguagagccgggagacaaaauaacauucgaagcaacuggaaaucuagugguaccgagauaugcauucacaauugaaagaaaugcuggaucugguauuaucauuucagauacaccaauccacgauugcaauacaacuugucagacacccaagggggcuauaaacaccagccucccauuucagaauauacauccgaucacaauuggaaaguguccaaaauauguaaaaagcacaaaauugcgacuggccacaggauugaggaaugucccgucuauucaaucuagaggccuauuuggggccauugccgguuucauugaagggggguggacaggaaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguaggcaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 38275 - RNA, 1701 nt, Artificial Sequence
  hemagglutinin__InfluenzaA__AET10090
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguccagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaaacugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucacaauauaccacaaaugugacaaugccugcauaggaucaaucagaaauggaacuuaugaccacaauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38276 - RNA, 1701 nt, Artificial Sequence
  hemagglutinin__InfluenzaA__AET10091
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguccagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccagauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucacaauauaccacaaaugugacaaugccugcauaggaucaaucagaaauggaacuuaugaccacaauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38277 - RNA, 1701 nt, Artificial Sequence
  hemagglutinin__InfluenzaA__AET10092
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguccagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucacaauauaccacaaaugugacaaugccugcauaggaucaaucagaaauggaacuuaugaccacaauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38278 - RNA, 1701 nt, Artificial Sequence
  hemagglutinin__InfluenzaA__AET10094
augaagacuaucauugcuuugagcugcauucuaugucugguuuucgcucaaaagcuuccuggaaaugacaacagcacggcaacgcugugccuugggcaccaugcaguaccaaacggaacgauagugaaaacaaucacgaaugaccaaauugaaguuacuaaugcuacugagcugguccagaguuccucaacaggugaaauaugugacaguccucaucagauccuugauggagaaaacugcacacuaauagaugcucuauugggagacccucagugugauggcuuccaaaauaagaaaugggaccuuuuuguugaacgaagcaaagccuacagcaguuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucacaauauaccacaaaugugacaaugccugcauaggaucaaucagaaauggaacuuaugaccacaauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38279 - RNA, 1701 nt, Artificial Sequence
  hemagglutinin__InfluenzaA__AET10095
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacugacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagauacacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaagaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugcgacaaugccugcauagaaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38280 - RNA, 1701 nt, Artificial Sequence
  hemagglutinin__InfluenzaA__AET10096
augaagacuaucauugcuuugagcuacauucuaugucugguuuucgcucaaaaauuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaacaggugaaauaugcgacaguccucaucagaucauugauggagaaaacugcacacuaauagaugcucuauugggagacccucagugugauggcuuccaaaauaagaaauggaaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaggcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaauguaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38281 - RNA, 1701 nt, Artificial Sequence
  hemagglutinin__InfluenzaA__AET10098
augaagacuaucauugcuuugagcuacauucuaugucugguuuucgcucaaaaauuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaacaggugaaauaugcgacaguccucaucagaucauugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaaguuucaauuggacuggagucacucaaaacggaacaagcucugcuugcauaaggagaucuaauaauaguuucuuuaguagauugaauugguugacccacuuaaacuucaaauacccagcauugaacgugacgaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38282 - RNA, 1701 nt, Artificial Sequence
  hemagglutinin__InfluenzaA__AET10099
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaauauuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcugguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38283 - RNA, 1701 nt, Artificial Sequence
  hemagglutinin__InfluenzaA__AET10100
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaaaggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38284 - RNA, 1701 nt, Artificial Sequence
  hemagglutinin__InfluenzaA__AET10101
augaagacuaucauugcuuugagcugcauucuaugucugguuuucgcucaaaagcuuccuggaaaugacaacagcacggcaacgcugugccuugggcaccaugcaguaccaaacggaacgauagugaaaacaaucacgaaugaccaaauugaaguuacuaaugcuacugagcugguccagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccgggugcggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucacaauauaccacaaaugugacaaugccugcauaggaucaaucagaaauggaacuuaugaccacaauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38285 - RNA, 1701 nt, Artificial Sequence
  hemagglutinin__InfluenzaA__AET10102
augaagacuaucauugcuuugagcuacauucuaugucugguuuucacucaaaaacuuccuggaaaugacaacagcacggcaacgcugugccuugggcaccaugcaguaccaaacgggacgauagugaaaacaaucacgaaugaccaaauugaaguuacuaaugcuacugagcugguucagaguuccucaacaggugaaauaugcgacaguccccaucagauccuugauggaaaaaacugcacacuaauagaugcccuauugggagacccucagugugauggcuuccaaaauaagaaaugggaccuuuuuguugaacgcagcaaagccuacagcaacuguuacccuuuugaugugccggauuaugccucccuuaggucacuaguugccucauccggcacacuggaguuuaacaaugaaagcuucaauuggacuggagucacucaaaacggaacaagcucugcuugcaugaggagaucuaaaagcaguuucuuuaguagauugaauugguugacccacuuaaacuucaaauacccagcauugaacgugacuaugccaaacgaugaacaauuugacaaauuguacauuugggggguucaccacccggguacggacaaagaccaaaucuuccuguaugcucaagcaucaggaagaaucacagucucuaccaaaagaagccaacaaacuguaaucccgaauaucggaucuagacccagaauaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaacucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcagguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggagaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaggaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuucguugggguucaucaugugggccugccaaaaaggcaacauuaggugcaacauuugcauuuga

SEQ ID NO: 38286 - RNA, 1701 nt, Artificial Sequence
  hemagglutinin__InfluenzaA__AET10103
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucggaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcagguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuagaugcaacauuugcauuuga

SEQ ID NO: 38287 - RNA, 1701 nt, Artificial Sequence
  hemagglutinin__InfluenzaA__AET10104
augaagacuaucauugcuuugagcuacauucuaugucugguuuucgcucaaaaauuuccuggaaaugacaacagcacggcaacgcugugccuugggcaccaugcaguaccaaacggaacgauagugaaaacaaucacgaaugaccaaauugaaguuacuaaugcuacugagcugguucagaauuccucaacaggugaaauaugcgacaguccucaucagaucauugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaggcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaaacugaauagauugaucgggaaaaccaacgagaaauuccaucagauugaaaaagaauucucagaagucgaagggagaauucaggaccuugggaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38288 - RNA, 1701 nt, Artificial Sequence
  hemagglutinin__InfluenzaA__AET10105
augaagacuaucauugcuuugagcuacauucuaugucugguuuucgcucaagaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaauauuccuguaugcucaagcagcaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38289 - RNA, 1701 nt, Artificial Sequence
  hemagglutinin__InfluenzaA__AET10106
augaagacuaucauugcuuugagcuacauucuaugucugguuuucgcucaaaaacuuccuggaaauuacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaggcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38290 - RNA, 1701 nt, Artificial Sequence
  hemagglutinin__InfluenzaA__AET10107
augaagacuaucauugcuuugagcuacauucuaugucugguuuucgcucaagaaauuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaagugcaacauuugcauuuga

SEQ ID NO: 38291 - RNA, 1701 nt, Artificial Sequence
  hemagglutinin__InfluenzaA__AET10108
augaagacuaucauugcuuugagcuacauucuaugucugguuuucgcucaaaaacuuccuggaaaugacaacagcacggcaacgcugugccuugggcaccaugcaguaccaaacgggacgauagugaaaacaaucacgaaugaccaaauugaaguuacuaaugcuacugagcugguccagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38292 - RNA, 1701 nt, Artificial Sequence
  hemagglutinin__InfluenzaA__AET10109
augaagacuaucauugcuuugagcuacauucuaugucugguuuucgcucaaaaacuuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccauuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaggcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38293 - RNA, 1701 nt, Artificial Sequence
  hemagglutinin__InfluenzaA__AET10110
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaggcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaagugcaacauuugcauuuga

SEQ ID NO: 38294 - RNA, 1701 nt, Artificial Sequence
  hemagglutinin__InfluenzaA__AET10111
augaagacuaucauugcuuugagcuacauucuaugucugguuuucgcucaagaaauuccuggaaaugacaacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugaguaacagcacagggaaucuaauugguccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaggcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 38295 - RNA, 1701 nt, Artificial Sequence
  hemagglutinin__InfluenzaA__AET10113
augaagacuaucauugcuuugagcuacauucuaugucugguuuucgcucaagaacuuccuggaaaugacaacagcacggcaacgcugugccuugggcaccaugcagugcaaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauucccaaugacaaaccauuccaaaauguaaacaggaucacauacggggccugucccagauaugucaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaaggggacaggcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcagagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgauuccagaucaagggaguugagcugaagucaggguacaaagauuggaucuuauggauuuccuuugccauaucauguuuuuugcuuuguguugcuuuguugggguucaucaugugggccugccaaaaaggcaacauuaggugcaacauuugcauuuga

SEQ ID NO: 38296 - RNA, 1701 nt, Artificial Sequence
  hemagglutinin__InfluenzaA__AET10114
augaagaccaucauugcuuugagcuacauucuaugucugguuuucgcucaagaacuuccuggaaaugacgacagcacggcaacgcugugccuugggcaccaugcagugccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaacaagaaaugggaccuuuuuguugaacgaagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaauuccgaauaucggaucuagacccagaguaaggaauaucccuagcagaguaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugcaugcaucacuccaaauggaagcauuuccaaugacaaaccauuccaaaauguaaacaggaucacauacggggccugucccagauaugucaagcaaaacacucugaaauuggcaacaggaaugagaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguguacagagaugaagcauuaaacaaccgauuccagaucaaaggaguugagcugaagucaggguacaaagauuggauccuauggauuuccuuugccauaucauguuuuuugcuuuguguugcuuuguugggguucaucaugugggccugccaaaaaggcaacauuaugugcaacauuugcauuuga

SEQ ID NO: 38297 - RNA, 1698 nt, Artificial Sequence
  hemagglutinin__InfluenzaA__AET50439
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauagguaaccaaaaggcccucuaucauacagaaaaugcuuaugucucuguagugucuucacauuauagcagaaaauucaccccagaaauagccaaaagacccaaaguaagagaucaagaaggaagaaucaauuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuuacaguguagaauaugcaucuaa

SEQ ID NO: 38298 - RNA, 1698 nt, Artificial Sequence
  hemagglutinin__InfluenzaA__AET50440
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccacccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauagguaaccaaaaggcccucuaucauacagaaaaugcuuaugucucuguagugucuucacauuauagcagaaaauucaccccagaaauagccaaaagacccaaaguaagagaucaagaaggaagaaucaauuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuuacaguguagaauaugcaucuaa
